United States Patent 10,407,724 (METHODS AND COMPOSITIONS FOR SCREENING AND TREATING DEVELOPMENTAL DISORDERS) - sequence listing, part 66

SEQ ID NO: 1858 - DNA, 1293028 bp, Homo sapiens
tgtaacataactgcgtgctttattgagatacacagtaaagcagtactataatacaatagtaaggcatatatttggtgaagtctgatatgttgtgaaaatgcagtaaaactgaagtttaaaaaaataattcgtaaatgttacagtgttggtgttaaaacacaatatattatgatactcaagtaagaactcagtacctgaaaacaatgacaaaacatgccatgtgatgtttatgcttcagttacattatgatttacagtttaatacttggtggttataaagaacacaacacgaaataatgtccaaattaattatgcttaaaatgcagcaataaagctctcaatttttgttcaaatattatgacagactcactccagagctaatgtgtctaaaagaaaaacaaaaagattaaaacaaaattatttatgcactctatttacctctgattttagaatgaaacttacttacttaaacttcttagtaggatgtaaagtaaccccttgttttaaatctgagttttaaaaatccttgggtaaagaaaaggtccagcgtcacataaaggaaaaaaatgcaagacaaaaaccaaatcttcatgtaatttggtaatttgttaccttagagctttgggttttcttttgaaaattatgaaggaaaaagaaagaattataaaggaaaaagaaaataacgcaatggacaagtggtgaagctgtgaactcaggtgtgcacaattatcaggaacaccccaaaaccaaagtgaggtagaaatagcatgagaagccgtgtttgatgttaattaattaattattaataatggacaaaacccactctccaaaagctaattacacttgatgtcagcccactctccaaaagctaattacacttgatgtcagaggtaacagatttgcaaaattataggtcacacggtggtatctattgaatgaatgatttaaaaatcaaaaagaaataaaatggcatgaaagagtaaagctttttcctaccagtccttagcttttcctcttgagcttttctcctcttttttgagcaatttttgtttgtttgtttatatatttaacctgtctaatccaccaagaagggtttttttgtaacatttgaatcaatttgccttctttcttacttacttacaaacctgtgtggaactactcgcagagaaatgcaaaggatggaaacacagttcatgggcttctgggttgatacctgtcagtatcacaaatgtgatggggctactgttttacaccttttcccaaagtttatttattttaaattatgtcttgtggcatttaaaaactcatcccacatgggacaataaatctaaaaaagcaacaaaaaccaaaccacccagttccttttgactgtgagaagagggcataataatttagttgtaattacagagaactttatgtattatgaacaatcatccaatccttcacttaaagagtggcctactccttcacagggatgggctgggaatccatagccctccagccctatcatcgtcctgctactgcttgggagttaaaaaataccttctgatgttcacaaggtcagaataccttctgattgatttccactgaagcatcattaaatctaaatcgtggcattgctagcagcaggaagctgaatgtatcaatcaatcaatcaatcaaccaaccaaccgattactcactctgatataataagtcctgtgtattcattcacatgttccctttaaaaaaatccaatactttactttactttcgttgtcagtggaaagttgtttaaaatgagaaacatctggagctgtagacaatgttttagtgtggtgtagtttcctcctggcttccggctccgggaaaaatccattctagaccaagcaggtaagcctggatgactgactagaagtaatttctttctattaggatgtgacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaatatagatttatttcttgtaaactcttactgtctaatcctctttgttgtatgaatattataaaaaccatgcgggaatcaggagttgtaaaacatttattctgctccttcttcatctgtcatgactgatactaaggactccatcgctctgcccaaatcatctgccatgtggaaaagacttcctacattgtgtcctggaaaacaaagagaaagaaagacagactttacaaaaggtgcagatagatagcatcactctgtttctttgccatttgggaaatcattccccatttctgggtgaagacaacacagaagctgcatcgagggtgtacacaacaaggtttgatttttcaccagtttccaggaagaagcaaagccttattaatgaagccattacacgttgtttgttagtatcagcttaatgttggatcaggctactggtgtttacatggaaaaatgtcaagctacattcaggttcccaatgtaaatatatatcaaaagaattccatagataagcacaagatttctatcagaacaggaatattccatgatgggatacatcttttccaccttggctatgagtgattgattgattacttactctctacttgtattaacgaacattttttttactatcaatcaaaccaccatcaccaccttcacaactaccactaccatcaccagcacccaaccatcgtcaccattatcactgccaccatcaccgccacaccaacttttcatttcaaagctgtttcaggctgttggcttgcttctgaggctatggtggaggtggctattttctctctgcttttacttgggttgaaaaataataataataaactcttgaattgaccttttggtgcactattaacatttgaattaggaaacctcagaataaaaattgctttacattccaaattactctagaccctaattataaggtgacccacatgtattgtatgcatttgggtattttgtgaatccatcttagagctcctcctaaatgagggttaactatcacaatagccttttactaataatgcagcacgacctagcacgaatctcccagcacggagaaaaagaacagcacaatgtccctgggtacttcgtagcaaaattcagatttagagtaagataatctgagacttactttatggcttgccttttcgtctatgtcccatagttttacatggctaattttaattattgcacattggtaaatccttccactattcaagtattgtctttggaactgaaatgctttactaggctattactaccttgccatgtatcaactttacagattcccataataattgttaaaaataccaataaaaattaaagatatcccaataaaaattaaagctatagactagggagagtattttgttttaatatttatttcaagagatatagcttctctacaaaatgaagcggattcacgggcaggcacttaaacagtgatggcaccagatcaactgaagacttacttattaaaagtttaatgtcattcaggcatttctattaaggtgaccaagtttgtatatctatctttttgtgctttattagtgcaaagaatttcatggagtattaattatattttagaaaatcactttggattttggctgagactgcaagtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattactagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaagtggtgcttctcttccttgaaatggtgttcagttactaactggaaggaaaattcttgagtctctcaagaagcataagttctaggggtatctgctatttaaagatttgccagggaaaacaggttcattattcttaatgtgccatgcacactccgacaaaaagttgggtggcctttaaccggtttacactgctgcattttcacaaatgaccttgtggccatctttgtgctataaaaataaagaacttttagagtcacctcatcatctatattatgcctttggttacttcactaaatacctgctttaccagaataaataattctaatttctttccatggagtttttcattagatccagaaaaaagaagtcaatctctttttacaaactactgccctaaagaatcatactttaatccgttggaggggtaagactgcactgtgacatgactatagaaagtagatttgtatcctagttctattatccatgtgtgtaaggcagagcattcgggaggtcattaatgttacctgacagatttttctaaagtcaaaattacaatctcatactatgaagtatgagaggtactgaaaagcagccaggattcaggcatttgcaatcaccttcaggcacaaggtgacagaaaactatgtctatagaaagtattgatttaatccattcttaaggattattgaacacaaaggcactatgccttgaacattagggcagttgtatgtttttcaagttggcgctaactgcaacacatttagtctcacacgtcaccactgcctgagggaattgttttccacagcgattggaattgagactttctggcaaagatccaagacctcaatagcaatctggtgctctattttttaaaaatacaattcccaaataaattgttagcattcagttgtccaaaggaaagccggaatactacagggaaatttgcttatcttttcttctctataatttaatctctgaaaaaaatctgctttacgtacatttgggatattttcatagcattaaaaaaggtcattattgttttgattctttggcttctggaaacttgtctgaacaccatacacctcaggtagtcaagtctgcaaatgcctatataacttcaattacatgtgctagccttttctgaaattcatttgtgagtgaaacatgtttaaggtggtcaaaattatggtgcatttttctacaaaaagttaaaatgaataaattttaaggggcacttaccataagaatgaacccaagaagtctcacatacgaagtacatgaaccaggcaaaccgtcaggggcattcaatgcttcaccaagtcaggtttcctcaatttctcctcccagcctaccattccctccctggccccactgcccaaagccttggaaggaggcactggcacagacacactgaagaatcattaaattgattagacttgtatggcatgatgttggcagagttttcattacgactcctgtgtttaaatgaatcagtggtctctccagtccatcctgttgctaaggaatccagaatcttctcatttaagaaggactctccacccatccagcctgtctcccagaacactgtcatcccatgggagagctttccttctctcctccttcagattaaattcttggtaaagacaaccttgattttacttgggctgtcagttaacactttgtcatccaacagtcacttaattaggtaattcgatattcagacaatattcctggtggaataggagtaagaagcatctttcaccgtaaaacctgaaaccacattcagtgataagactgcaccctatccctttcaacccataaataggcattttaaaaacctctcaaaactccaatatttaattttttaatcgaattggttattgttctgtgtggcttcaaataccaaataaaaaagatcatcttctgaagggtacgttgagatgatgtaagcctttcaaatgagagttaagagtgtgggtctggagccagactgcctggatccaaatccttggctctgtcacctgggacacactgcttactctctcattgactcagtctccttatctgtaaaacggggttaataagagtacctacctcacaggtttgtcatgaagatgacatgatgaaaaagatggcaagtgctgagaacaatgcttggcacacagtaagtgctcaaaaaatgttcgctaaaatgggagagaaagagcgtaggaaccaagaaaaaaggaaacaaaagcaaaatgaagtcatcccagaagaataaaaactaagggcgctggcagaaaatgctaaggtcctggaagtggaagaaagctttatgactcatcagttatgttcaaggctaaatttattttgaagattttgttagtgttgcaaatggcaacagatgatgaacggcaggattccaacctagggactacaaaggattgccattttaaagagattcttgctcccaaccccagtcttgtcgtcatggtgatgacaacggcaatgaacatttgaggaatgttcctcatgagctgcaagtggagaggtgactaccatccttacatgatgacacaatgtgtaatacacacatgcgcgtgcacacacacaattcttacacaaacgccaaacataaaaagcaggatgagacagacagaagccatggccgtgagcctgaatctcactaacctctctcattggctttccaggggtatttcttcctttaataatagagagaggaagaggcagagatatcagaaagggaaaaaaaacatgcataaatatacaatttcataccaatttgcttcttttaccaaacaaatgttgagatgaccatttattctctgctggaaaaaaaaaaaaaaaaaaaaacagaaacaaaaaacccaaaagacacatctagtcaaataacctttacatacacttaagatcagtgtaaacagataacatgatccagaagacgtcatttgtaaaatccatagagttcacgcattaaactggatgaaaactggcacagaatagaaatctgacaaattgggcattgttttcaaggacaactcaaacttaatgttaaaaaaagtctcagaatctcttcactcttgacaatcagcacattgaaacataaacagtagttgactctgtgtgcccaaagtctgcacatcaaatgcaaggtagaacccgacatagaggctggactccatcctcttgggagaatttgttctatctgatagaagctgagcatttccatgatgaaattggaggcatttgagaaaacagaaagaacagatgaggggaagaggtaagtcccagtaatgggcaagccacagagccagatccaggaatgagctttccacttcctccccaattcagcaaatatcaggagccttacgaggcaatggctaaagacccactggccttgattcatagattcctacatctgtatgcatttatttgtatttcaaaagtagactctgatgagaaagtgttctatgataagtcataattggacagaaaagtagggacttctgtccatacatgtcaatagcctgtcttgggcatgcaatttcctttaaaatcttggttttcaaactgttttaactatagcaatgggacatctcctaaaacaatcttatatggaattccaatattttgagcagttcaaagcagagctgtgagagatcctgtacagcatctccctttcccctccacccatcattctcagtggctccaagaagactaaaaactccctgaaacaatttgagaactactagtctggaatgaagaggtatggagctacgacaccaatagaaacctttcaaaactcactcaaggttagggttcaaaacttctagtatacatttaaggatagtttctaagtttttcttccctctctccttctctttcttccctccctttctccttctctcccttcctctcttccttctgaatttcctacatgactcagcgatttcttaggagtatcagattttcagcttgaccacgtaagggccaggtatttaagatgctcctcaagccagggaaaagagggagaaaaatgggtactagctcctcagctgtgggtgtcactagtgggagatccataccaaatgatgttcccatcatttggggaggagaacatcattctttccttgatggctgaaatcccagtatgaatcactcaccccttctttttgattcctttagcaaggtttttttaaaaaagtatctttatgtttcataatactgtctggtggcagaattaattcccttcccctgtaagactataagcctcttgaggacggggtccacatgttgctcatccacctctctatgcccaatgccctgtaccgtatatacacacttttggtatttgataaatactggctgaagtgaattggtaaagtagtagttgggtcatgaccaagaggagtccttctgtgttataagtaacttgcccttcactggcacactttagtttggatgccaaaggtgggtaacttgtttcggcatgtaactttggtctagttttgaaaacttgagatctttaggaaggacagtgttgttagaaagccatgtgatttagaatgtaattatggttatgtacttcagaatgtaacgatgattctttgaatgcttaatgatacatatctttagtaattctacactaagccatattcagaactcagttatcaattgattatttcttaatatgtagcagcaaatgacttgtgttatgttccagatccttcttcagaaaccatattttatgaaaatggacctcccagagccaagctaactctaatctcttctaaaatcctccctcatcacttgggtccccacgtactcattaacacattacaaaaggaaggtcctttttttcactttagaaaaagttaaaaacaaatgatattttctactgtaaaaggactagttctacgctgacaaaacagaggctacttgattacaacatttttaaaagttcttgaccgataaataaagtttcagatatgtttcattttctaaacatttatttttttttggaaatgagtttctgtagaccttcagttacagtgtccatctggcaatgtgatgtgttgtcaggaaatgaatcaagacaaaagggaagtgtgctggggcagtcctgagtctaaataaagggcttggtcaggtcccgagaagtctaatttcctcgggcactataaaattgacattattgattgtaattcattattttagagttggaattgcaggacagtactgtttctgggtgcttttagcctcttttatattaattcactgactatttaaaatacttaaggaagaataagtccctttttaggatttctgttattttataagtcaaaaaaattcaaatggccacacttgcaggctctttggtgaatatgaatataaatctataaatcaattcaatttcagctcaataatcttgttcagctgaaagttgatcagcacagaagcctgtgactctatacatgtaatgagtcagaatggacaacgaaataatagcgtaaagcagggattggcaaattttccccataaagggccagatagtaaatatttcaggctttgcaagcccacggtctctggaccagctattcagcactgctgcaactactctgccctggtaatgagaaagcaactataggcaacatgtaaatgaatgggtatggctgtgttccaataaagctttataaaaacaggtattgggccagatttggcatttgggctgtatgtagtttgctagtcctggattaaagggataaccgctcaaatcctttgtgggagcatacaggaaacagaatggtgcctgaaaaagggcacaccatatttctatctgcctttgttctttatgttgctcttccataaaagaaccacagaataagattttaattttaaaagacggtaggttttacaaagctgttgggttggtaatttaggggtatttgatagaatgtacgcgggcttatttgagaggggatggtatgaaaaaaagaggatggcatgggctggtggagataatgtggcacaggtcagtaggcaagagattgtacaggtagcagaaatagtagcactgctaactgctttctggattgttttactgcattaagagcttatcttggctcctattattcattcatctatataaagtggtaccacattttagagagcctaataccatactactgactaggagagcgtttctttcatcaatgcacatacatataaaaatatctttgttagtctgctaaatgatcagagacttatggacaaatcacttaatggggttattttttaaattacgtttgtttattgtacccatgtagttttcctatagaatggcagagctttagagagtaccttatagtaaagtagataatgacttattacactataattcaatttctacacatatacttacaaaggaagagattagagatagacagattagatagaaattggctaatattcagtgttcaaatatacactgagccactcaaatctcccaagtgtttgtgaacaactaagtatatctagagaccaaccagaaagatataatcacaaagctgaatgtttacacattcatatcttgaatatgctcctgcttatattgcctattatgcaggatagtgttggccatcggtttatcactaaatggagaagcatgccactcatttattaattttgataacagtttagcaaagccattaagataagattagaagcctaacttaacctgctgaatggccataaataaggcacttgacttttcttggcttccaggtactctttgtgaaaataaaagataaagaaaggttagctgacaccttcaggaccaactctgtggcaaggggcaacagaaaagttgtaaatttgaggtacataatagcttacctatctatatactttatgtttatgaagagcataagttttttaaaaacggcttttcctctgtgggcaattatctagcagggttaagtaaaccacgcggtggtatttaatagcacatttccactaaatgtcagacctctggctctcacatctgttttgagttactcaaacagctgtccaaaacagctgtagcaatcatgaactttgttttttgtaacacaacaatgagaacatggatggtagtgttagaataaaactataaaggtctctgagacattagcaacgtcttggcagaaacttccacggcaaaaatctcaaaatttaaatttttttgaaagataattcaaccaggcaagaaaaactgagatcacatagattagtatttttaaaccactggttcagaaaatccatttagtgggttgcaaccagcattttgtttttaaataaataaaatagaaaaacagcatgcactgtatgtagtatggaaggcatcacttgatgaaacttttgtttctgatctttgtatgcatatgacactgtaaatgtgtgtgtgtacatatggtgggtgtatatatacatgtgtgtacataaacacatgtacaatttattttatatctttaccccagtttgtgatgtaaaatgttcctctgatatggataaccatcaaaacagagtcagaaatcactgtcctggatgtcaaaagtgttaaaatgacctttcaaggctcttccatttgaaagactttgtaatcccaagatgttaagattctcaagaatttctgcttaatatcagctgaacacatctaccaactggtaagatgttcccgccaaacttgacggtatatgtgtgtgtacacacacatatgccatttttcaaaattaaaaaacaaaagtgcttttagttggaaagaaagcatccaaaaaccacttttttgagtgcatcaataattagcctaatttttacaataatgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcccttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggctgcctatgaagaagcagagtcatgagccttgctgtagcttcttctctactaacctcttgtttagatgtggaagaaatgcccagggtgccaacagggcagccagcaactttccagagcaggtaagcaagctgccagttcaaggggccaggatcatacagtaatcaatgattgtactgtgatttgaatttctttggagttctgtatctgcaattgaccataagtaccttgaaggcaaggaatttgtcatttcttctttccatccctactacctccactggtacgtagtaggtgctagtaaaagcaagcaggacaaagtaatgaggagacacgtgaaagcacctgattctgtcaagcctgtgtatgatcttctcattatgaattatgacatctagaagaaggagatacctaagatagtcagaatggggatgcgggtggcggtgggggatgtggaggtgggtggaagacagataagatttttatctgttaaaatcatcacttcagtggcgctcagcagtgaaaagatggctggtgcagacatttaaaattagcttcccctgacggttccttagcaacgctctaccagaacattattgcttttaatgtgcactgcacaacgtttacttgcacatcaaatagctaggaaatggccattgttaactgacactgaacaaaaagataggaaaaacacactactcaatacaccctcctcattgcccttatggagaggaacaaacagcccagatttcctgctgcccgtccctcccaggctacccattagaggtgccaatcactggccacaaagccttgtgttttctcccttttgtttctctaggcttttcttctatttgatcacaggtgactgccaccatcctttttattcgttgaaggaaggcgagagagtgactttgttttatgtgagggcaataaaccaaataaatgcccccagaaacgaacagtagcagcaaaacatcatcttggatgaagcaagacatctgaagctcatgcaagccagtgggaaaattctgcagggtaaaatgctgtttttgtatgggggtaaaatacgcaaggccaaagtgatgaagaaaaagaaaaatattaatgtctttctttgctaagcctgtatttcctctatcgaagtaaaaaataaccaactactctatgaagatttaattgtccctatatttaaatgatggagtaagatacaatttttaaatataaagggcatcagatggcaagtcagaatctctaccactaccaatcagtaggcattgttctaggccttgctgtagcacgtagtagccatatgtccctggcaaaggcactatcagggcattaatttcctcatctgtaaaagtcacataataattgctcttcagtaaagggcacctcataattaactcttcagactaatgtgtgaagcaagtaaaatacttgacaaatagagggtggtattcttatttttggaaacatgttgccctcacgggtatttgaattcagagtactctaaaccacaaattcacacttaaaaatcaaatcttttcaccatggacccaaattgccattctgatactgcgtgttggcttccatatggaaaatacacacaccagttgggtagggaagcgagtggcctgatcccagcaaatctgagtcccttctaggtattggagcttacctcttgaactagggaaggagttgttgagttgctccatcacctcctctaaccctgtgcttgtgtcctggggaggactgagaagatcttcctcaccttaataaaagcaaaaacaaataatggaaaattacatttatagaaaacagatattaaagggccatgattacatttttaacaccattataaattcatttcacttgctcataaataacaaagaaaaccctcaagcttaataatgaggaagtaattctttaaagggaagaagaaatccatacagtagtttatctatatcattacccttggagaaaaaaaaactgtatatctttttttttttttttttttgagatggagtcttgctctgtcacccaggctggagtgcagtggcacgatcttggctcactgcaacctccgcctcccaggttcaaacgattcttctgcctcagcctcccgagtagctgggactacaggcatgcgccaacacgtccagctaatttttgtatttttagtagagacagggtttcaccatattggccaggctggtctcgaactcctgacctcatgatctgcccacctcagcctcccaaagtgctgggattacaggcgtgagccaacacgcccagcctactgcgtatctttttaaaagttgactagttacttgaaatgtgccccgcacatagaaatgataaatacatgagataatgaatactctaaataccctgacttgatcattaacacattctgtgtatgcaacaaaatatcaaatgcactccataaatatgtacaaatattatactacagtaaaaaacaggctgggtgcggtcgctcatgcctgtaatcccagccctttgggaagccgaggtgggaggattgtttgctgccaggaatttgagagcagcttgggcaacatagtgagaccctgtctctatttaaaaacaaaaaaacaaaaaaacaaaaaataaatttaaaagttaaaaagaataaaagaaaaagtcaattgaaaaaggtaaaactgacaagctctcttttgtgccccattcacaaatgtgaaactttgttctatgtaataaaataagtattactgcacacttgcagtgctgtctcctcaacacaaaagagtaagaattgaacactttgcagtcacttcatgaaggtaagaagggagttgagacactgaggtctttttttcactctttgttttgacatttaaccaaaaatacaaacgaaactcaagtacctttaaactccaatgtaatagaaataaaaatagtatatatcctatataggtaatgaaatatgaatattctaaaaactgtagatatggcatatattggagagttatggtcctttcctctgttacttgggactactttatcataattatgttttgggttttataaagaagacattacaaacattttgactgtttatgtgaggagagaatgatgatctggaagcaaagaaacctatggatggatgatattcactgggaatggaaatctccttgtagattttgtgaatctgtgtctgtattgtttgttcatgtgttaaagaaatacacttcaaacagcatttgcaagttaaagggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattagaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttcctcccccctcacacacatgcactatttgcttaagtttatgcctttagaaaaagaagtgaaattcactatttttagtttcatttttcttgcggttttaaactaccattatctggtgaagatgaaatgaatgaaatactaccaagaggatcaagatcctgacaactgcagggctgattacatctctctgtttcattactgatgcaaatttttgcggaactgggaaacatgaggcatttttaatggcagtaagtccacttcagtgacagtatgcctcactgaataaatcagaaccaagagaacatcatgaacgacgctcatgaacatcgatgttaatatttctgacagtttaattacatcatattggagctctaggaactcaattgtactgtgttaaaattcaggtacagttcaatgaagtgactggcattcctgttcctgaattatttcaaagatcaaattataaagtataaacctaatgatgtcagccaagtttatttttccagataaactctctgtgagtctttaatatgagtgtccaagtataatacaaatgtaaaattggcttctttgctttaatggaaaacttttaaggcagtgataattgtatccattcagacatttttttgagtgcctattacattctaggtagtataaaaacaagtagagtataatcttgttttcttcttttctccatattttcatgatttctcaagatggttttaatgcattgctttttttctctttttctttttttttgagatggagtcttgctctgtcacccaggctggagtgcagtggtggaatctcggctagctgcaacctctgccttccgggttcaagtgattctcctgcctcagcctcctgagtagctgggactacaggcgcgtgccaccacgcctggctaattttttatattttttagtagagacagggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcactgttcaaatggttgaacagtgcctggcatattgttcactgaagatatagcaataagcaaacaaaccccacccacacactctctctgtgaaactcgcattcataaggaggcacacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatagagatactacctgagactgggtaatttataaaggaaagaggtttaattgactcacagttccagatgcgtgaggaggcctcaggaggcctcatgattataagtttagaatcatggtggaaggcaaaggggaagcaaggcacctcttacatggcagcaggagagagagagagagagagagagagagagagagagagagagagagagagagagagagagagagaagggggaagtgccacacactttaaaaaccatcagctctcctgagaactcactcactatcacgagaacagcatgggggaaaacttcttcatgatccagtcacctcccatcaggtccctcccctgacacgtggggattacaatttgagatgagatttaggtgggaacacagagccaaaccatattaataggcaacctcaaaatatttctgactctaacaataatacctgtcatcacaagcccctcatcaccaaaaacaaaaacaccttttcacttttttcacttattcaacaagaaaatactgagttccagttgcacactagagacctgcacagcccttatccctacttcacagattcattgcctgctcaaatagcatattgctagtctttgggggattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatggatgcacccaaatgtcagaaatcaccaccgaagaacttattcatgtaaccaaacaccacctgggttccctgaaaactactgaaataataaaaagagaaaaataatgttttttggattattagctatttggtcttcctggcttgtctgattgtggtccaaataaatcactgaaacattttttaaaataaggaaagacatagtcaaagttaaatagtaccgtgatatagcaaaatatgatagtctcctttaatcactgctgaagtgaagaaaaaagaagtgggatgactcaatttaatccgagaaaaaagaaaaggaatgctttgccatggcaagatattcttcagtcttctgaaatataacgatggtttcagatccctttcttgaagggaagatatcccatctgactcacttccctttgattcaaacgctgataatggttctatctgcttaaaaagtgattttagccagaacctacgcagcctatgcagaatagacacaagaattactcctgtgtttttgtctgaatctaaacaaattattttctcttttttttaaaaaggagctgtgtacaagaaattattttttctcataaagggggctgtgtatgaacaaatacgcccaccaacatttttctttggattttaaccagtttccgacttgatgtgttattatcttagtacttgtgtatttcctgcctttctccagtattttttagaagaaaaagcacactgatgtatccaatacccaacatttggctacaattaatttttttccatatgatataggaccgatgctttcaatttcacacataaattctgtgtgtaacacctttaacatattatggtgtacaatgttgttgctgattattagctgatcagttgtgaatggtggtgaaagatactgaaactagtagctaaatttcctaaacgtgtgggctgttccatgtgtacacaagaatgtattatgcttgatttctaaaatattaactcaacaagcactttactgattgtttgttgcacagagtatcctcatacagtaacgacaatgagcaagacttacatcctgtccttaaggagcttaagttctagggagttgtaggcagaagaaagaagtactagtaactggctgaaaacatggctgggtgtggtggctcatgcctttaatcccagcactttgggaggctgaggcgggtggattgcttgaggttgggagttcaagaacagcctggccaacatggtgaaaccctgtctctactaaaaatacaagaaaaagtagccaggcatggtggcgagcctgtaatcccagctactcaggagggtgaggcaggagaatcgcttgaacccaggaggtggaggttgcaatgagctgagatcgcaccactgcactccagcctgggcaataaagcgagactccgtctcacacaaaagaaacaacaacaacaacaacaacaacaacaacaacaaaaccagaatgatataatgcatgattaagttccaaaagaaaactcactgagtgaaaagaaaggatgctatatttcaggttaagaacataatgtactcaaggccaaagagcacatttattctgttgtcaaacagaaggcataaaatgcttaaagaggggaataatatgatataatttgaatggtagaagaggaactgaagtttctggaagatagcttagaaagggagagagaccaaaggcagaggaaccaattaggaaagtattcatattgtctgttcaggtaacacatgatgagggctaaatttgggcagaagtagctgaattgaagaattttgctctttttcataagtagcaaaacacactgaccttggtgactggattgatggtggtggaacatagctaaggaaggcaggtaaaggaagaaggggtagaaaatgactttgtatagattgggaaattggaagagatgctccaaaggttgatcatgatttcagattaggctatatttttatttataattttatccagaagatgctcaggtgggaggtctgggctggaaatcttgacttaagagttgtcagcatagcagaagccaaagtatggaaggagcgcccagggagagtgaagaacggtgaaggggatggagaatcttgaggaaaaccttgatgtgatgtactgaggataccttacctatatggtaatctggcataaaacatttaacccgaacccaatcacttggatacaagcagacaaattcaaattgggggacattctacaaaacatctagcccgacctcttctaatatatcaatgtcatgaaagatttaaagaggctgggaaagtgcttcagattaaaggagactacagggacatcactgatcctgaatgtaaaatatcgctatgaagaatattaattggcagaattggaggtatttgaatttaaattctacattatataacagtattgttctttttgagcatgataattgtgcttatgcaagaatatctttcattttagaaggcacgtgttcaagtgtttaggggtgaagtgttatgtatgaaacctaaccattgagtggatcagtgaaaaaaaaatccacaaactatatacacgcatgaatatgattaaatatgcacataaaatataaacatatacagtatataaaaatatgttaacatacagatatacatgttaatctaaatatatgcaatccatttaacaacacatgaatgtaaaagtacataaataaatagctataaagcaaatgtggcaaactgttgaattaattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacgtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaaggcttttttcctttttaaatgaagttagcttatgcagttcgatatggtttggttctgtgtccccatccaaatctcatgttgaattgtaatccccatgtgctgcgggaggggtccggtgggaggtgactggatcatggcggcggtttcccccatgctgttctcatgatagtgagttcgcataagatctgatggtttaaaagtgtggcagttctcccctcgctttctctctcctgccgctatgtagcacatgccttgcttccccttcaccttcccccatgattgtaagtttcctgaggcctccccagccttgtggaactgagtcaataaacctctttcttcataaattacccagtctcaggtagttctttatagcagtgtgaaaacagattaatacacagttcaagaaaaagtacccttgaattcagtcttttctttcagaggacaaatttaacacagcttatccattttatgccagcaagttatctcttagcttagccattggaatatagcacttttgtcctggtattcagttctaccatgatctttttagctccacagatcatcaggaccacatcctaatgtgcactttaatttgagtgctttaacgagtatgctgcctattcgccattgtcaacgacctaaataattattaatgcttctaagcacccagggctctgaatctgaccactaaaatatgtaacttagtttcatatgctttacttacttaaaaaagggggaaaatcctgaagtagaaaaaaataagaggtactaaagctcagttgttttcagaatttacagactttgcaaatgcatacagttgtttttcatgtagtgtgttgtcatttacaatcccaacagtttattagctatattcagatctcaggtggagggagataatctgacacagagattgccttaaatcatggaggtgtagtaaattcaggaaaataacctcaaacatatccttttccttctcaaaaaaatcaaaacctggctttcctacaagatttggcttctccagaggaggatgtgcctcttcccactgctccaggttcttgaacttcatcacatttatttcaactaccctgtctctttcctcagaaatgttcatctcctcagagccctcgtccatcttcttcaacatcttttccatcctgatctaccactgtcgtcaggatctggacctcacccctctgctgataagctcagcaacgttggtctcatcaactccatgaactgtactccctacccctcagtgatctccaagtaaaatcttcagcagctcgctgggaggcaccatgttagatgtagaaattgcttgaaagtattttacttccatgatatccaacttttgaattttcccgactgtgatctccaaatttttcgccataaaactcacccacacccctgacttttcctttctgtcctatccattttggttaaggcactttgcctccctttattctaccctcatggaagagctcaagtatgaaatgaattcctgaacacatcatcatatcaggcaatagagctgtaagtgtatggaatcaaggagtcacaggtcttttctattctgtgaggtaagatttgagaggaccaagtatataaccagtttaggtcccagggaaaagtaaggagagaggatggagctgactcctactgggcctttacagagaaagagaaatgaggaagggggaccaagtatttgtggccttcataaaaccctctattgtctagccagacacagcaggaaaaaccaatgagcagctggctaggaacccctgtcctagccattcattaccactgtaaaatgccctactcttgttttgacctttgatcatttatgcctcatcagctccacctttcttagaacctagtcctaggcagagaacattgctaagaatgagaacagaacatgtggaccatttcctcaacaaattcatccaacttttgcctaaggcttccttcttacttggtaatgtttcaaaattgtcttcactttccttaatcctcattcattttaagattacctagtctttcatttcattgaaacagaagttttccaccttcccttctcttggcctaaaatggtttctcaaaattacccaatgcatttatagtgacccaatggactgtgatttattttaatttccattgagctctctttagcatttcacctttttgtcacatcttccttgaacctccctacttatccatcctttactatcccattacccaaatggaggtcttttccaaggcactggatcgaagcacctgtgttatagattttatagatttctcatctcacacccttcagcaatcaattctatgaaactcattctcaaatctctccagtttgcccacttacttcaagtatagatctgtatcttaatttcttttgggacatgacttagaagacctgtcaatttctcaaacacattatgtccacaatcagaagtttcactatcttcttccaaccaaatcctctcccttcattcctcttcttacaatttgcactcagtccccagaccctgggaactctattttttttttttttttttgagacacagtcttgctctgtcgcccaggctggagtgcaatggtgccatcttggctcactgcaacctccgcctcctgggctcaagcgattctcctgcctcatcctcccgagtagctgggactataggcgcccaccaccatgcctggctaatttttctatttttagtagagacagggtttcaccatattggccgggctggtcttcaactcctaaccttgtgatccgcccacctcaccctcccaaagtgctgggattacaggcgtgagcctccacgcccagccccctggcaagtctatttttatagaatagtctcacagtcctctcctcccacatctctcaagtgcaggccctcagaactcaccaatcttggccttggcaattgcctcctaactggtcttctcacctatacaagttttctgtgggccagatagagctgccagaatacacctttttagaattttctttttagacttttttcgcctggtatatgattttcagtggctccctgataccaagatgagtcaaacacttacggccaaatattcatgtccctgtaatacgactctacctttcttcagacaacaaaatctgagagtagctaggacacttacccatggagtccgaagtttgactgccaaccactcggagcagcataggctgactgctgtcggacctctgtagagaggtagaaggagaggacaccgttgtgccattcactttggcctctgcctggggctaagtcatccaaaagaaaacagaattacttttcataataaacatacaaatgtataaatttcaaaatatgatacacactcaggactcataaattttgacccttcctactttagaagccctcccaaagattgtttaatttgggatatttcactgttgatataatccatagaaactgtctttgtatctgaattgtgctcccttataaatttgagaaaaaaatcagagctacactggaatgagactatacatcattacattaaataactggaagatttagaaggtcatgtgtgaatgatgagactatgtgagatctcaaaactgtaatggaagattcatatctttgtgaagtattaagtaacaagatagagagaacataattgaaaaatttaaaattcccagaaagccagaactatgtccaggtaggtcctcttacaatgcagtatcttgctaggttttcgatggaggcttaaagaactatgtgttagggattaggagaaaaaaaacacaaaggtataccagaaaatataactaattgtaaatgaaatagttccatttcaagaagtgaaatattcacttttagagaactagtggaaacctttaggcgtttttttccccaagatgtatttcaaattggtcaagaaaaaaccattttggtaggaaacaatattggacaaatacaaaaaagacacactagtttttctatctcctctacttctatcctttgatactatcactttgcaggcacataccaagcacttaagaattgatgcttgttgcacctataaaaagtgctctctgaggtttagttttgtttaagagggaaaaatgaatgtttgtaaaaatcccatctctctcctcacttgctccagcagctgccttagcctgtgtaactgtgactccagctgtttattgtggtcttccaggatttgcatcctggcttccaggcggcctttgtgttgacgcagtagcttggcctcagcaatgagctcagcatcccggggactctggggagaggtgggcatcatttcaggaggggacggcagtggggacaggcctttatgttcgtgctgctgctttagacggtcatattctgcttgcagattcctattggcatcaaaaaagtaaaaaagaaaaaaaaagaaagaaaaagaaaaagaagaaaaaaagtaatttgaatatcatcaccaaattttatataccatggtagatagatgcatctgactgccaccgaagaacagcaagcaaaagaggcactaatgaatggttttaatgatgacaatcttaccagtgctaaaagaacaaaacaaaatttgaagcttttgcctggtgtgtgaagggagccatgcttttcaattttttatgttacactaaaagcctcgcgactggtatgttcagataagtaagcagcaaaggatttaatcactttgtaaatatttctttataatgtcatgagattaaaaattttatacctctatcaacactttggtttgctctaaacattagcaaatattttcaacagaaatgtataagaatggagtaagtatacccatgttcctatcacctccccttgataagtttatcatttgccatattttcttcaaaagttttttgaagaaagaaaagttaacagccaaagcagaagctccctcacatgcccgcctcaacaccataccattctctcctccccgctgccctcaaggagataatgccacactgaatttcatgcccagtgttaccatgaatgtatcaacaaatactaggttgagcttaaaaaagatgctgatgtttgcctgtatttttctttcacctacaaaaacacccattttatgtgattcaatctaataacattattttgcatgtttttaaactttaaatttaagaacttcacatttaagaatatacataccattctaagagttgctttttgccttcaacaccattttggagatttctccaggtcgatacataatagtttgctattttaactgccataaggtattattattctgttgcttgaatatgccaacattttcctgtccatggacatttaggttgtttccaacttttcactattataaacaatgatacaatgaaattcttttttatacctatctccttggatacctgttgaagagattctttacagaatatagtttgatgtggaattgttggatcttagcaacatcttcaacattgctacatgtcaccgaatcgctctgggtgacaaatcggtgcttttaccaatttactctcgcttcagtagtgaatgaggttttccatttggcccacctcctcaccaaatacttggtgttatcagacattcaagttttagttaacctgatgggtgcattttaatttgcacatacatcccggattactggcaaggttagacttcttccatgttaactggcttttcatgcttcctttacccattttcctgctggattgtctttttctttttaaacctttggatatgttctagatgctaatccattgttagttatgtgcatggcaaatatgatcttctacccttatcttagtgtagcttatctttaactttgcttatggcatcctatggtataaaagatgtaaattttaacatatccctgtatgttctctgctttttatgttttgttcacgaaaatcttttcttacacctacattttaaagtttaaaatttggtttttcacatttaggacttgaatttacccagaatctatttttgtgcttgccgtgaacatgcgatctaattttacttttcccccatggataaactatgaagccagcctcattcattgtatggtccatctatttcccactgatctctaacgatgcttccgcaaaacatcaagtgtccataaatatacaggtgtgcttctgagctctgtattctagtctgtggttctatctgcatatccctggtagatcccacactccagctttaaatcaattgatgtctgataggccttctcagcccactttgtttttcctcaaaattgtcttgactattctgacccctttgatcttctccatgattttagtgtttggttttctgattttatgaaaatgcttgttgaaattttgagtttgaattacattgaattcataggttaaactgggaagaactaagttcataataattgagtcttcacatccaagaatgcagtgaagctccttacttactatggtctcattttatgtccattaataatgttttacttgttactcttttttttcctcttgctttacaggttgaataagtcattgattttttatttttaatgaacacatttagggttatacatttcctccttggtaccactttaattatataccaaaagtttttatatacatcacctgattcaattcagtgccttatgttttgtaattcttactgtgatttcttttaacttaacccatagtcatttaggagcacagtggttatatttccattttcacttcttagtgcatttctaatttaattgcgtttcaatcagagaacccctgtatgatactgatcctttgaaatttagcaatacttctttttgtgacctagttcacagtcactttctaaaaatgttcattgagtacttgaaataatgtgtatttttccattggaaagatggagtctctaaatacatagtgtgctgattttgttgttaaaattgtccatatctttattaatttttgattatttgtagctatcaatttttgttagatgagtgttgagatataattatggatttgttagtttctccttttaattctatcataattcactttatatatttctagacctatatagttagatgcacagaagatcctcgttgttcttgcactgtttctaggtagtatactttttcttcctaataatgttgattgccataaattttattccatttaaaggtttctatggttattccactgtcttttggttatatttggttaatttccaaataaatataaacagtattagcacatgtgaaggtcccaaatgctttaggatttactgagaatacaattccaattgaggacatttctgatatttgatatccagtgactgattagaactcttgacatctttcttctacttgtgataaataccaaaataagatgacagatttctgttgttcacagatgatatttcatcaggtgagagaaattcctatccacaaatgtgggagatctatatcaatgagaaaagagatgaaatgtaagtagtgagtagccaagaagagttttcccattgtccagtttgagaaagcaagatcatctcatcaccaggtctgctaaatattttctgttgtcccatactcggaatgaacattccacaggggacggcatgtcttccaaaatgctcagtttcaaaaggctagatctccacatggaagcagaaagaaaacccaatctactctggtttttttctttgttttgttttgcttcatttttttcattctacctagtacctaacattacaaggtttccaggaatttatttaaagtcacacagaaaatcaatgtatgatctttttcatctacagaaatagaatctcctatctgtactgattgaaatcctattgctatcagccttcaagggtagttgtttgtatagtttatttcatagcaatctgctttgacaaagcagtgatgagaagagattcatcgaagtaagtacaccttcagtcagattctgcacacgggtcttctgggtgtgcaccgatgtatgtaactgtccacattaattaaatctaatttctgagaacttaactggcaatcagttcaatgtttctgtgaacttgaagcagtatccaatgttcacaaggtctcattccataggaattactttctatttttccctcttcattaaaagaaaacttcaacaaaatgttctaactggcaacactttttatgtagaatcctattcaaatttttctttctaccagattggggcagccatggtgttccttttgaaaacagtttttagacatggacctcaagatggtacaacaagccattactgtcttcccacctatttttcacaaaggtgctgacaggagactgccttttctagagagatcttccttggtatcttgatcctgtgggtttagttgtccacagggctcttcttttatgatttatttataaggacccttgttcaagaggcatggtttggtatatacaacacattacatttctgttttggtggtttccagtgaaaacagaaaaggctcattttaatcagccaaagctgagctgtaaagaatatcaattgctcaatgcaggcctttctttccttcccagatgtttgaaatttctcttgggagcacatttccttcaagactcacatccttcttcaattctggaagattctcagctatgacagcttcaaatattacttctctaccatttcctccattttcttctgaaacctctcaaatacactcctaaacaaacctctaaattctagtaaggtatattgtagagcctgtggtcaattctccatttctcctaattgctcatttatatttcttatctttttctgtgagtgttgtacacagtaacattctcagcatcatcttctaattcccttgccttctctgacaggacaaagtctagaatttatcctgtatattgagtttagtaacttcaatgactagtttttttggcaaagatatctttgttttcagacctagttacatttcatccatctctgtttcttagtttcttgttattttagcgagtggtaccccttatttatgcctttaagcatctttttttttttttttgagatggaggctggggtgcagtggcacgatctccgctcactgcaaccaccacctcctgggttcaagcgactctcctgcctcagcctcctgagtagctgggattacaggtgcctgccaccatgcccagctaatttttgtatttttagtagaggcagggtttcaccatgttgggcaggctgttcttgaactcctgacctcaggtgatccacccatctcagcctcccagagtgctgggattacaggcgtgagccactgcacctggtctgagcatcttaaatgtaagtaaaaatctttgttgtactagtgtattattttgctttcttctagaattaattcatctttttttttttttgagatagggtctcactctgttgcccaggatggagtgcagtggcacaattatggctcaatgcagcctcatcctcctgggctcaagcgatcctcctatctcagcctcctgagtagttgggactacaggcatgtaccaccactcctggctaatatattttaaattattttttgtaaagatggcacctcactacattgccctggctagtctcaaacacctgggcacaagcagtcctcccaccttggcctcccaaagtgataggattacaggtgtgagccactgttcccagcctaattcactttttgatgtttaacttgggtggggggtgctatcccatttcttcatgtattttggatcgtgatttggagacaaattttgcaagggatgttttgcatgtgcatacatatgcatgtgtatgttttctattattctcatgtgtgtgtactttaatattttcctctctttttaaactcattatctctctctcaggtggttttatggcttctcccagccatacccaggggcttagagtttagagccacatctgttggtagtttgcagctcctacactgagtgatacagagatatcactcatttcattgccaggcagtaggtagattggttcaggtcctggtttcaaggctgtgatgctctctttcccaactgcgaatctttgcctcttccctcggctctatgcattagggccatagctgcatataagctgtagacccttgcagcaaactgtttcttttcatgttgcttttaagtgtaagtgtgtatgtgtctctctctaggtgtgtttttgtggggctctgatttcaaatagtaatcctggctttgggccactaccttgtaaggagaattttaatccctgttactacagcacgagctgaaagcccactaatttagccccacttacttttttttttttctttcacatttctggttcacagagatgttcatcttgctttaaagcccagctatgtctttttcatttttcactccatatattatctaccactggataaatggtaggagcagagaaagatgccttcaagcaagagctaatgttatcttaatcagaagcctaccaggacacattgattttgtagatgtatagtcaaggttccctcagtattaattcaagccttaattcatcaggccaggattaaatgagtcgaacaagtgcttttcttctaaacaaacatatgacatacagaaacctcttattaagctcaatagcaaacttgattttgagggactagtttttcctcctgaagctctgagataggacaagctgtcatgataaggattctaaaagccagaaatggttaaaagaggtatcttggcctgcaaccaaatgaaataaggttttttgatttgagtctgaattctcttttaaggtatttctaaatgttcatgagaattatcaagaagaactgatgctggagggtttgaactagagatgatttttactaaatgttttctaataaatgcagtcatagtcacagagctgtgttagggcatatttttgttaggggttgggaaattgagccatttagcccttatcaattacgcatttgaattttcttatatttaaaaacatctatgccaatactttttgaggtataccataatgttagttttgatgcagtattaacgtaggggagatcattctcataaatgatcaaggttccctcagagttactgttccaaggtaagttattctaatgttttttttttatttttttattttttattttttgagacggaatctcgctctgtcgcccatgctggagtgcagtggtgcgatctcagctcactgcaagctctgcctcctgggttcacattctcctgcctcagcctccagagtcactgggactacaggtgcccgccaccacgcccggctttttttttttgtatttttagtagagacagggtttcaccgtgttagccaggatggtctccatctcctgacctcgtgatccgcctgcctcggcctcccaaagtgctgggattacaggtgtgagccaacatgcccagcctctaatgtttaacaagtacacaatgcactcgttttaacagctgtcaattattaccaatacatattttgcttttcttgaaggtatacacgtacatctcacccctaatgattctctaattgttagaatgtagtcatgaagtcatttcaatacagatgaatatatgtcagtgatcagacaacgactccacagagaatctatttacgttcttgattatcttgtaaattatatttctctggtagctccctaaggaacattaattcaaattcaatacacatggcttctgtcactacaatttcttcctgtagccagtcatcctaaaaaaagtcttccatccagtatttcttattctctatagagctaagaatccccccattctacaaatatgtagatatatctgattaattttatgtcataaagaatataaactctgttgtctacatacaaatttacactcaaaaaaacttcccaaccaactaatggacataagagattaatcaaattggcaaggcttgttcccttaactcaacctgctgaaaacatgaaagcagctggcccttttagcaatgatttatgagtgcctctctagcaatcgtaactattatgtatgataaagaacattacaacaatctctgtgtaatttaaactaatttacaaaggtcaaatgatttcagtgtaagtcatctactctttaaatggagcttccctactacgtgtagttatatagttgtataatgatatttatgaaataaagaaatgaaggtcactttccagtgatcaatgttttcttaacagtatcatacatttaactgtataccaaagcatgagcacacacagggattattttgtaaagtagaacaactacaaagattgccatctaaaaggaatagatccaaagaaatctggctttaccctcatataatattaaaagcagctaaatcatatccaccaatctaaattcaggcaaatgtagtaaatcatacagaactattacagcagctataaatgtagccaatcagcagtttttttttaaatgaaagacaaattctgcaagcaagatgaactttaaaaactggaaattgcattgagcccttgaaattacaataaagctcagtgcaatggctcacacctgtaatcccagcactttgggaggttgaggtgggaggatcacttgagctcaggagttcaagaccagcctgggcaacatagggagacacccccaccatctttacaaaaaaattgaaaaaaattagccatatgtcgtgacacatgcctgtagtctcagctactcaggaggaggaggctggggtgggaggaccgcttgagtctgggaggttgaggctgcagtgagccatgatcatgccactgcactccaagctgggtaacagagggagactccatttaaaaaaaaaagtgacaataaaattttacagtacagctttagacatctttatcaaacacaaattcaaaaatacccctaaactaggtggaaaaagacattaataaggataagctcacagggtgagaagtaagactatgcatattttaggtcagccttaagcaaaacagtaaaaatggcaggacccctccaggctcttgtttctaatcatttcttagcactgtccccctttaaaacattcagagccttacttccaagccctttcctactgaaatttgctcagtataaaggttttatataagacatttacattttactgggattttataataaagttgtcatttcttctagtgatatctgcattttaaaacagatgtcaaagaacgtaaaggaaaaaaataaaagctttgccccatcaggggaaaggttgaacaatgccactttttgacacgctgcctttgtggtgcctttcaccatccatggctgaggagagaattagaacaaggcttgagagatggtcttggattcagaagatcttgatttatgacttacttgcctctgctgcttgctgaggctgggcaactgacttaagcactaattcagttatgaggattattaagccagtatggtcgacattctatatgtcaaactttctttgaaccatgcccagcccatactgtgttcaataaatgttggttactattattattgttattacttctttctctatatattatttactttttggatttagaacctcagatgtgctaaaaacttcctataaaaagaaagcacttaattatctgaaatggaagcaatctacttagacctactgagcttggcagaacatatgcatatctagcgcttagaaagtgactaatcactcagtatttgtcctgtagatacctgagttctagcccctagccacattgtagccacccccaaattttggaattattgtgtatcatccatcatctgtgccttagtaaagtttatcacagctgaacatctgggcaaaatgaaatcactgagttaagatcactaggatgagatttccttgatttgacccaatacgctaggtatgtgatgaaactgtcaaattataatatgtccatggatcattgctgaaataaaatatgtggaccaagggtacagggttaatgtatctaggtggagtctattttctggatatgtcattgacacgtagatctgtatcttgctcaagttccaagagacagaacatgacaatattaattggcttcagtttcttaatctttaatgactgagatgtttttcacaaattcctgatcagatgctaattcattactgtctatagactaaatgtattaatcaaaagttcaacacaagaagaattcataagaaattttaaccacttataactggaaataagacagactaacaaaacctaagacaaaaatggcagtggctggtcatcatcagccaaaaggaaaaactaggattggagaggttttagaggtgaagaactctagtcctcaggaatactgccattgggaaaagtgtgtttccattttcagacaaatacagcaaaatatcaaactttcattgtctgtggtcagcaaaaagccgtaacagtctctagaagaatcataattttaagctttgtgtgtcccggcttcaatccctcatgcgtagttagacttagtcttaagttctcccagtaacttcaatttgatggcctatttttcactccctggcatgcactgctatatactcttgccatatatgatcctatggcctcctctattacaatgacagaaactatagaatcttttttttttttttctttttttgagacagggccttgctctgtcacccaggctggagtgcagtggtgtaatcatagctcactgtaaccttgaattcctgggctcaagtgatcctccagccccagcctcttgagtagttgggactacaggcatgagccaccatgcctggctaattaaaaaaaaaaattgtagagacggtatctccccatgttgcccaggctggtctcaaattcttggtctcaagtgatcctcccacctcagcctgccaaagtgttgggtttacaggtgtgagccaccatgcccagcccagaataacttctttaaaataattaccggtacttgtacatgaatgttcatagctgcattatccataacagacaataagtagaaatagcccaaatgtccatcaagtaatgaatagattaaaaaatgtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaaaattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtcttcagaattatccgtgtggacattaaatattttcagatgatgagttttaaaaagagtccaaaaataagcccagaaaatgcttaagtctgggttagcctaaacaacttggatggtttcagtctaatggaaaatgacatcacaaactaaacaggtatattaagggattttgggaaagaaaataatgtaagaaatgagaaaaacaagggagatacctgaaaatcaaccccaaaaacccatcaagtaacagaaaaactccaaaggatatttacccattcatttttatgacacatttatgtacccagtgctgtggagataaagatatatgtaggacactgtcccttacccttgaagagctcacattctagagtgtgggatattgtttacttccaccatggaaacaaaccttactcgaaggcaaaaagactgggaatcatgctcactgctaaagctaaaaatacagatttttatctttgaaattatcgccttgatttaccaggaaattacaggaaaagaatcatatggatttacttatgacttgtagttacaacagacagactagcaccataaggtaactcagaatttggagacacaagaaaaggtcatattttaactattaagatagtaaaaaaataaaatgggtgagtttagccatctgcagaagccatccatgtacatatgtaataccaacaggaaaccatttctaactgggctgctcatgcccaattacaatcaagtacatcaggaggtccttggtcttcttcttacacaaactctcttcctaggaggtctctgtcctctccccaggcttccatctccgccacaaccatgaccccttcccgcaactcattactccttaatcaagacttctcttctaaggcttcagacctatctctccaacattctcctggatggctccattagccatgggctctagaagctgaaacttgctaagcaccaagccacacgaggttgatatactgattatgcaagctctaaaatttcagtgccaggaaaggaacagccttcctcaagtagcattacacaggaccatatagtagctacacatctttgtaacttataccttaatcttactttgagatgaaagctatacctgcatttctgtcataagataaagagggagaaatatcttcccatgtgttgatgatacactttaaaatcacaatccaggagaggcctcaagcaacaactggcctttgcatctaactacttacaaagaaagattccacagtaattgtgatgaagctaaaggtgctgtctttggtaaacatctttcaaagttcaatcatttcacaagaaagaactcccgatagcaagttaattgcatcaagtcactggtggcaatttttcttggtggtttgggtgaaaagccaagttattcggtgggatattctacaaaaatggtgcaaagaattttctatgatcatgagagttaatttaatacctatctttagatttttcagactaaatcattctggcttctgggtctacagggtaactgcttcaccactagagcatatgaaaagttacttttgtgcgaaaaatccaggcttcctacgtgggcacctgttatagctttatcttctgatgttcccagagacacaacggataggcttctcaacaactacagtagagagtcaactatgctatctcctagactggttttcaaagtttacttcagacttgaatttctttaccaaagtgtgttccatataacattgcagttgggctcgaggtcaagtaagtgggagcaacatgaggttagacaaagctaatcaggtttcttcacttccaaactcctcagtgcaaatgctaacgtaatgatgactttccagtatgagtgctttcaaagttttactgtccttggaatcctttttttctcagagtatctcagtggtattctgcagaatacattttaggcaacagtgacctttatccttggagaactgtcaccctatctttggtgttttaatgttaagctttccacaattatcaaaggccatgagaaacagccacatataatttcccttgggatttgttataaaaatgttgataaggacactagccaataatcacttcaagtgtaacgctgcttaagagttcaggaccaccacccaagtttgaatacaggtcctattacttgctggccatatgaagtgtccttaatactctgtgccacgtaatcctctggaaacagcctctctttcatagggttgttttaaggattaaataggagttcatatgtactcagaacagttcctgtccatagcaatcactcaaaggacagctatttttgttattattattattacgtagagccaggaaaacaatgatgtttctttaggatgctgcgtgcttctttaattcaatattaagagacagacaaatctttgtttcctattatctccctggctacagggaagctcaaactgaatctgaagcttagtcaaatcaactatgctaatccctatgatgttcattgatctattatttatattgcaggaattgtattgctatgactttttaaagaatcctttctgaaaactgaatacgtaaaatcaacataggaaatttccacttgaaatgtccttgggcaaatagaattcagtatgtctgatacgtagctctttctctccatgcactaaccctttgcaaatcaggagtttttcctgggtgcactaggttgcttttgtttgtttttcaatgatcatttcccagttcccaaattaaaactttccgtaacaccagatgcctccccctctccattttcccttggtctcattcattcagtgaccttctaatttctccatccccttcttcacttgcctaagacatccttagttaagaacctggcatcttttaatggactattccactgtgcttctaccaatcttcatggctttagctttctgccaggtcagttatttttctcaatcctcccccccgtcaaaaagccatcactgttcacctgcttataggataaaacccaaactccttagtatgatgcacaaagtcctttaaacagtagtccccacctaccatcccactgccctcttattctcctcattccaagccacacattactcactggtccaccagtctggaaaactcatccttcccccatctctcagactggaaaactcccattcagtcttcaactcttaaactctctttgtaaaggcctctctactccctctgatagaataaatcattcacctctgtgcccccagagcacttgtaacagtaggatataagtagttgtttctattttaacttttttaaaataaattttgagctccatgagggtaagaaccaaggcttattcatctttgtagtctcataattttaaaattacattaagcactcagtaactatctgcagaattgaacagaattacatcctcaggcctggaaagtagctaaagaaactcatgaccataatcaattctactgtagagggacaattggcaaatgaaggccaacaggaggatgagggtcttcatgaaaaatctaaaaaaaaaaaaaaaaaaaaaagggaaattggattgtaagaacataaactcttatccagcatgttctagggagatggcagctgtacttgtaagatgtgaatattctaatcgccagaggggtgcttcaatttttttgtagtatgaagcagtcctcacaaacatccaattttagatgccaagattctaggctcaccagaacacaatttgatttttattgtgattcctaagacactggattctaagacacaggatgctgtgtgccgaaaaaatgaatatattcctcattttaatagatctagtatttgcacttaaaccagatgctgtctcctcctaaaaaagctttaaggcaaccttgataacattttaatacaaggcagttaaaaagagagataattaggataaagggagaaataaactttcattctgggttatccattcactgccatgaactgcatactatgaatcagtcccctcagacttcaattaactttggataaactgaaggaaatttagttacactggccctgctagttagaaactgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttctatcaccttacttaaggctctaatcatctctttcctgggctcccatgtgactccccccagcttgatttcctcgttccagcatcgctcttttcaaagttaccctccgcacagctgcctgtgtggcgtatattcatgtcaatatcatggcctgactcctggatcacacccttgagttgctccctagactaggcacggaggcagcaactctgcagtgggtaccacacccttcccgacctgcccttgctgacctggtcagcctcatctcctctcattctttgccttcttaaaaaaggtaatacaactgcagtttccctcaaacaaactctgccattcctcaccctgacacctttgtttatattccataggaatgcccattcctaacctcttcagattcccttcattttggccatcttttcaccatcattggagacttgcacaaagacctaatgaaagaacattgaataaagatttcccgtagctatgaagattgatagctactagactaggtccaaagtcatcaagtcaattacaaagtaaagcaacgggatcatgatttccagctactttaattcagtggtatcagtaactgatctagaacttctttgactgtaacaataataatcttgcacaatcactggaggaatttaaaggaaaaagagaaaactcaaattttggcttcataaggtcttactgcccaacaagacatatgaaaggtcctgagtaggtattaagaatctacagagttccctcgtgttatataacatctactaacaactttaactttagactttatggtgaattaggttaatatttagccaccttgttgacttgagaacaatctaatcaatttgctctgcaggtagtagaacgacaatgtctttgtctctcagaaaggctaccttttcattgctaggatcataccttgaatttcagagcaagtcttggtttatttagacagtgcagagacaaatacatctctgtatttgaacactacaggcttaagtcaggagactgaaggctttaatcaacgcaagaaaaaaaagtaaaccttgagtctgcaatgctaaggacacacaatggggcaaaaacccaagatccagtggctctttgccaaataaagatgtatctgaattatatgtggtaatgagggagaaatatgatgcagaagcgaaatattaaagattagatatctcactaacaccattagtcatccaaacttatgggaggcactatgggaaaaactcagtcagatttagcttttactcagagctttagccttatctctgtggcatcaaccaagaatcagagaacaccaatgtgggatacatacagtgcctgtgatttggaaaacgggttcttaacattctaaatttatgacaaagccatgcctggtgctaatcaaggcagtttgaaaaaggggagaattttgaaaagcaagcagaaaacaaagtctttgaaaggcttttctctacgaaattaggtttgtaaaagaactttagtcaaaagtgcatgcatgtatgctacaattaaaataaattcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataagtacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggctgttttcaggaagggaactctgtggagacatttctttggaatttggtagaaggtcaaataggacaaaatgaagggacaatgaaggaagctcatcctgatcatttcgtgaaggtcaaggtaacttacacaaagatttgcatcaaccccagagtcctcattttggagctctaagtaggcctggtgttatgttttttgttcttttagagaacaaaccatcccattcttggagaatggtcttggatatcttccagggtaaagcggttatcgctgtgccacaagtagatgaacaggtttattccgggacactcagtcctcatagatagtccctcaagttaaggcacattctggggaatatgccgcaattctatgtaaatgacattcacagagacttactcttctttattatctggttgaaggcagagttgcctatttagagtcagaaaaatctggatttcaattcagttctaccactggctgactgggaaatctggggcaagctgtgtgaacctctaagaacctgtgtctcattcacagaaaggcgacagtctcttctccatagcgtttgtaagaagattaaatgatctaaaatatgtaaaagtgcactcaaaatgataaaatgataaataaatgatagttatcagtactctttacaaacattctttgacccgggtgcaatggtacggagaaagactatgctaaccacaaacgaggcagggctcttgaccaatgagctcaaaagatatattacacgatcatatacttcaaaaatatatttactccttggtaacatcaaattctatttacagtgtcagttccaactttttattccgatttgactttgacccctacaataattacagatttaacataaatggatattactgattattctcaataaagtagaaatgttttctctaccatggtcttcactgacaaatgatctcaaaagtacggccaaaaataaagctatcattaaaacaacaaaaaaagttcaatattatctcgtggatggtactcatgtgatgttcttgctgtattttcaggtttttagcaaacatttcctgagtagccattaaatattcaaaccatgctaagtactctggaggatatgaagatgattaagatacagtccatgccccaaagacacacactagctcattaaagagaggcactggtaataactgataaaaaggaaaactgtcaaggaattttctgagaaaggtccaaagtgctctgggaatagaggcaaaagacagatttcttccaactgcagggatctagcagggctccatggggaaagttattttgagcagtgtgatggaggataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtgggaaagagactaaagggaagccaaccagataaggagctatggccataggtaaaaggtgttaagagctagaaggctcgcagtggcagcaggaagcaatggaagagtggcagtttgttttttcatcctgaagtggcatactcccgagggcactgatctcagacacactgcgttgcctacgttaagagcttttggtgccttgggctcaaccaaagagatgaaagtacttaagacccacaaatctgagcaacatctactttaaatccttgcttggtggcatctgtctgaagaaggcacattgtgagttagaagtgatcatgtgagaagactttttaaaccaagggacctgtgacataataaatgtaatacagaactgaaagtccaatgatttgcattatcctgacacaatacagtaccccagatgtttacatctttgtcctccctgcagtcattatgagagttctttagcctttttctcttctacaatttctgctatttttacatgactgtcttttacaggtgatggctgacaattggaattgtctcactaacctgctatgatggtgagcataaataataatttctgcatttgatgatgaaaaataagatgaaacaattggtttcccaatatgaccaagccaataaccctactttcttaaatgtttgaggtagataatatggccaaacacatgtaaaaaaaatcatataatcataaaattaaataacctacttttttcttaaattctattctgaaatataaaatcaaagccttggagacacatgcaacaagtcaaataccaccatcagcattaactccttcacacctaaaatatgagttcttcatcatactattgcatccattgtcttctttcagataacaaaaaaaaaaaagagagagagaatctgcaaatggagctaaacagattattttagaaaacaattagacataaaatgactctaagtgaagattcctggcacttttctatgtgtgcaagtgtatgcactctgcataccaatgacaaagctagaaagaaaactcacctgttttcttcctcaagatctgctaggattctctctagctcccctctttcctcactctctaaggaaatcaagatctgggcaggactacgaggctggctcaggggggagtcctggttcaaactttggcagtaatgctggattaacaaatgttcatcatctctggaaaataaaatcaaaggttttggttttttcccccccttattttgctttgggggttagggactcaggagtgtatttgaaaatagaaacatttatttgctcttaacaattaattagaccttttttcctgcttctaaagaccttttgatactgctgaggttgtgatctaccattctactggtaccaattcaaagtgttttcttgctcagattttcaaatgaaattgattggcctatttacacggataaatgaaaggcagaattacagaaatactgggactctacgttgatgttagtcaatagctaaaaaatattaaaagatataataatggctgtataatgctttggccaccaagcctgtcaagataatctgttcactaacccacgctattgttgtactgagtaggaaaaaataccttgcagctctaaaagtaacagaggaaatattttattaagtggaaggcaatgtaaccaaaaagtattgcttcagtaagtcagttttaacttatataagtcattgaggcagaatgacaacaacaattaaactggagatacatgattgtttcattcagttattgtttagacagaagaacgaaaattaaggggaaaaaagacattaaggtgactgattaaaagaagactgaacatctcattcctcggggcagagtttttttaaatacaagttttatttatttttaaatttatacataatggttttaaggactaatcttgcgggaaaaggaggcaaaaaggcttctatttggggaggcagctacaatctttcctggaaactaggaactctctaatacacaggacaaacttttttctgaatgcattgctccaagctccggaaaggcctgtttacctccaagttataagaattttcttctgtccgtaatgacaggctaaagctcattgtttctggttagatatcattaagatgatacgctaatattctcctctccatacccacttaagttgaaaaatatcagaaatttaggaaaaagtccttctcatttgaattatttttgtttatcaagccagttacctggtttagatgtgaaaagctgactaaaaataattattgggtattaaaaacacacatttaagtgaagtcaaccaatccaccaaaccacttccccaaacctgcccctaaaatgccatgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaatagccatgctataccaagatcacgtttccactccccatgagtggagaaaatagtacttagccatgactttaaaattaatatcctatccctttaaatatctggcaggtttggtcaaagattaagcattactataaatacttgggactctgcaatttgtaatcatatggtatgaaataagttcaaataagagtaaggcaaactatttttgctactctgaatactaataatgccagaatttggatgagctcattccatgccagggcattaagaattaaaggaaaaaagtaaatgaatggctccttaaaagatcaaatgaatatgatgctaattcctatatcctgtgctatcctacctctaaatccctcaaagcaatttcattgtcaggaacattttgtaaaaagagatgggatacttacatgctctcattaggagagatgctatcatttagataagatccattgctgttttccatttctgctagcctgataaaaaacgtaaaagctcattaaaacttatgtgacgtcttagaatctattcaagacctaatcgaacattcctgaaaactaaaggataaatcatggcaagaagagaaaggaatccttcaaattaaaggatgtgtgtgttggcttaaccatttgaggcagtgtgtggtagaccacagctagttagtagcactacatttatgatagaaattctaaggaaagttatatttcactgttttccccctacagatcagtcttgctttcactgagaacaggtctttgttttcagaagaaaagcttccctaacaataagtgcactccctaccttacactaccccttgtcttttaggacaattactactttccactgatgacagacttacacagctagctaatgcttttcacgattggtaaacatgtccagcagttagaatattgacaaaggatggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacggaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagatttgtttaaaatatcataggttagctttccttggttagttatttcaatcaatatttgcctggcatacaactagtctcatacctgctagcataatgttcaatgcgtgaatgagtatcatcgtgtgaaagctgaggggacgaggcaggcctataaggcagaaaatgtgattagtcacagataccatccattaatggagaaaaaacccaccacacagttatgttatacacatggcctagaatgcttttattctaattctatggataatgtatacatttagttgctcctatatcttaaatattatcaagtattttaaaatccaggattgagagatgatttctcatacttctgcttttattaaaagccatgaagagaggccaaaatcttctctggaaaattcccatcgtagaaaaggttgggggagacagtttctaggaagcattttgtcctcctactttgtaatttctcacatcctataattccgaaattgtgttagccctatgtggtttaaaattttaaatagtttacacctgcgccatttataggctatcttcttattggatcaaagctgtatatctgcctagatacttacaattattttagcttcaaagaggctactctagtacaagacttcttaaaactccatgtatcaagatgtcttgatctatgcaattttgtaaagaagaaatgtatcttccaattcagcagcaagactataccactaatttctagcacaaaatagaatgaccctggattatattgtgaggttttaaaaaagaatgactaaatttcatagaacgtcatgatatctgaaatatttcttagagatactgtgtgctaaaacataggtgagaaaataagaggagatcattagcaggaatagtctatatgctttttgtatataaacacctatcttttcttatctccataggctagaattctggtagggttaacattttttcatcctttcatatctgatctattaattatccttgaagtttttatagtatcttttggattaaccttaggaaaaaaaaccatctgttctgaaaaccagtttaggcttggactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaaacttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcagggaaaatacattagtagtgttttcccttgtaatagttgctatcctggaagtgtgtacaagaatgaaagcctaagaccttggagcataagtacaccaagaaaagtaggcatataaatccaaaatactttaataccattttatacagaaaatcttatacagagctttaattctttgcctcaaggataattccatgttatttttcttattaatatcagtggcgcctatcacagcatgcataagcacaagaacttacaataaccagaaatcttaaaaaatatacactaaaagagacatttattaaaccagaaaatgagccaaaagggagtactggtcagagatgaatcatttaaaaaccaagaattagtgaaaatacaaagccacttagtccacaaacaaaactaagtgcaaagccttctaaaacacttccaaaagaaggtaataatactgttccccgcttcccacttcctaaacacaaaaccatatacccagaaggattacttactataagagttaatgacctacttggtcaattccatcccacccaccaccaccttctcttttatgaaaactctattaattaaaagctgacattcatttaggtttcaatgcagaatcgctcaaagaatatcgtttgactggctcacttatggacagacaacgtaaaggcctatgttagctttagttttaaagtaatatgacaaacacaagcaaataagagtttagtctaaggaaaaccaaacggtctgtatctctggaaactttcaaattctgtgatccatatcaaatggatcaaatattgtaatcatcataggatttgttaacattagatacaagtcttgcaaaatgaaacacgttaggacctggctcttatgcctgaataggatggctttgtaatatattttatacagtatttataatcctatgaataaatactttaaatacaattactgctattaaagaaaacacagacttcagtctgctagatttgttttcttcctcaaaattaaaacttcccactatttctgaataatctaaccaactcttcataaaaaggcaaattgggaggtgtgttttagttgttagaaaatatttttaaataaaagatgttattaattttaaagtctttcaacgtttaagacagacaaaatcttctacttaaaataagttaatctgattgtcataatgtttttctcattagcttacgtgtagctcctttttgcctttcaaggactattaattactctttgtttattatttggtgctacttttatctatgtatttgtaacaactgttctttagcatatttgtcgtttggatttcttactcggttaaacttatttccacatagagtaaatccattcccttatcaggatccaatcaagctgaaactgtagtgtatcaactctttaaaagtttcttatttatgaacggttgtaacttctataacagactacctgggttaggaaacacaatttccaagaggcagaggacataactgaacctaaataactccctaagttctttaagcatgatgattaaataaatcagataatatactacttatagctaccatatctcaaaattaaggggcgcaataacgaagttttaaaaaggaaagcatagccttccacttcctttaggcctattaaagactgaaaataaacctcaattaataatatgcatttatcacgacagggtttttaaaaaaggatctagtttagattaaattatatggtggaacaataaaaaagatttaataaaaagaaattgaattcttacacaagcttatcttccgaattggtcatttcccctttatccataacagagctgtctgattttcaataaatattttaataaagcatactttgaaataccaaaagtttgttataacaaccctacataatgtagttttaaaataggcactttgtttgctaatatagaaatcacaggccccaaaaaagagttttctagcattataaactctgagataaatcatctgctggtatctaagctcagtattattaatacacaccaatagtaataacaaagaaatactttcctcctagagcaaatgtataattgtttatgagctgaatatttagcttggagaggagagcaaagtgagtttagttcaaaatttagaaacccttgtatataatgattagtcaaatagcatggcataacctgataaacagtccgcacacctcattaaaattattcaaccaaactcagcatcatactttaaaacgaattctgctgatttttaatagtccacttataacagaccctaaagattctaaaaagcatcgaatctcaagaaatatggctaaagaatgttattatgtaatcagaagcttcttccttgcttttatatgaagaaatatataaacatgtctcccaggaatacagctaaaactccaataacttctttgattataatttgaattcaagccaggatttctgctggtttgaatttcacctggtggaggaaccaaaaaacccactctgattctcctgatctgtgtagatggtactttcaaagtctcatcaagaaaagaaaaaaaaaaactgaaatgaaggaaggggaattaatatgtccataaaacaaaacaaaacaaaagaaaacaaacaaataaacagaacaaaagagaaccaagcgagcgaatgtgttggtggtagcagcacccttcagcaaaaaaagtactcacgcagaatctactggccagaagttgatcagagtaacgggactgcaaaacaaaaaatgaggtggtgaaggagacacacgcaaactcagccgcaaaaaaatttactgaaaggtcaaaataaataaaatccagccaattaagtatgaaccatggaaagcaatagccaaaccaaggtgtaaagtgaattaaaagaaaaacacacagttgtgtgactgccatcagagttaaggcaaaaaagaggagcaggttgaaaagaggtgaagacgtcccctttgatcttgagaatcattactacttactgtgaagtagtttcctgtgactatattttcttttgagtagaaacaagtgactagatatgaccacacaatgagatacaaaaagacacacatttactgatttgtgagagaggaaaatcaaaatgaaatactggaatcactcatttgtaaacagtcccatatttcttataaggcttgtaaggcaattagtggctgtattgtgttgtggtttttttttttttttccccctgtgagataaagtttaacttttggaaaaagaaattgtcaagtgacgtgggaaagtggcaactggacatcagcttatttttctcttttcagctaatgtaaataaaaagaaagaaatagaagagactgtttgcatttgggagtgaaggagggtgttcagctgagaggagttcaaatatacatcaaacaagagtgtgttctgcttttgctactactcacgtttccatgttgtccccctctaagacagtctgcactggcaggtagcccattcggggatgcttcgcaaaataccttttggttcgaaatttgttttttagtaccttggcaaagtctcgaacatcttctcctgatgtagtctaaaagggagatcatggtgagatcagatttaggacaggatgatttcaaaactaatgaccactccagtcttctgccccatgacacttgttttgtaattaaggagagtgttgtggttgtgagcaaaggctttggaatcagacaaatggggctctgaaaccaggcctggcatgtactaatttggctgagttatttacttctcagaggctctgatcatcagtaaaatgggagcaacaacacctcaacacgttgttatgataaataaaagaaacatacaagcttactaggctactcaataaatggtagtttataggtcttaaggtcaaaaaggtgacattaaattttaccacactttatggtattttaaaaactacttagtacaaaatgatagcatgcttcacccactaaatttcggtctattcatagcatggtacattctcaatcactgaccatctctataagaggaataaaagtgagacaggcaaatatctgggaggatcactctgatgatggaagagagagatgctctaaagcagagcttctcatactttgttgtgtatgggaaccagctgcagatctcgctaaaatgtgggttttgatttagagcatcaggagttggggcctgtggtttcacatttctaataaagaccaaggtaatgccaatagacatatgatgattagtcaacagaccgtatcttgaatagcaagcatgcaaagtttagagaagaggagactgtaagaattaaagaaagagaagagaaacacgaagggtggctctacagtcaacagggacaggtttattttagaaaaaacaaacctgagaggagcctgtctttaattcttaggcagatttgtactcaggtctgtctggccaccaagtctacatccttgccatttccctagtgatttttcacagttctattggccacttaacattttcctaaaataacatcttaggagatggcttcaactcttacttatagaaccttgagtaaattatttaacctcaggacctcagggtcctcatctgtatagaggggataaaaatcatagtacttattttacacagggtagtttaaaaggtaaatgcctagcatttagtaagtgttagcatataaaatggatttttaaaatgtcactagtatacaggacagataataggtgagcaacattgattaaaagtggtagtttatgaatttgggggaacctagaaccatcccccatactcaacatgcctcatggccataagatcgccccacacaacctctaaggctgtgcaaaataaacgtgaaaacgtcttcaatacaaccatgcacacagaatgaaaaccctatttattcatccaacaatatttattgagggtctatcatgttccatatgtgccaggcactcccctaggcaccagggatagggtaaatcctgaagcctacagttgagagccactttagctggggaacatctggggaagtgacaaatcacagcattatacatgatctgcagtattgtacaaaactgaaatttatcccaggtgaactaactctcacgtcaggctggcgtcaaacttaccggagtgcaatattccaccatgggatagtgcattttatggccttttgcaactcgaccagaaaaaaagcagctttggcagatgtcataattaaagtgctttagactcctgtacctgataaagagcaaaaacaaacacgtatgtatttcttcgaatcaaattcccaaagaacactctttaataaaccttctaccacgttctaatttgagaaacagaaagcaatgttcattagtcccacaaggtaagtgattaactttctgcctccagatttttccggtgcctctcctacagtaccaaaacattttggcagaaagattatcctataaacatatggaaggagggaagaaaaactcagcttttatttaaactccactaggaactctttgagattaagtaggaaggtactggaaaatttccagtcttttgaaaaccaaatactcaaatttaaaagaacttccaggagcgacagacttacgctgtgcatgccccttacccatcatgggacaaaagttttctgaagcaattattttcaaaacattgtcaagataaagcaatttcacaagacaaaagaaatgtgaacaagaactttcaattaaaacaagtctcgctttaataatgttttctaattgactgatacgattcatcttcaaacagttactcgaatgaactcttttatctctatctcttcagaaatctctcaccccattacctacaaatgataactgaagccccaagagaacatgaaatttggattagatggaagaatttataatctgtaaatactagttggtacatttcctccattatcagaatgcgatattctttgtttcatactctcctgccttttgctttctcagataagaaccttagccaattcaaataaacatatttcttatgtcacatatggggaagtgggaaggaaagctatcttttttagattccagccatctttcaagagggggacaggaggaatgagaagtgctgggtcctaaaataatataatatgataagggcaaaagaattgaaggtgaaagtgctctttcagatcctccaaggcattcttcttctttattttataaaaatttcccttgtatacaaagcccactagctaaggaagcagagaaaaggtagcttagaaatctaatgcagtcactgtggcttcccttccccactccccacccccatggtatcatttttacctgccaagaaaccgggaaggaaagaaggtgacctttgcaagcagtacctactcactgttgtctatctaggcttcagaaacctctaaaagtttttgtaaaacctctttgtaaacagcatgactatggaacaataaacaccaaaagtaaaaaagcactatgaataaaaagcacgcaacagtacaaggtagttattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactatcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattcttgggaagtttctataaacaggaaagaccgtgaaaaaggaaagatggtaaaaatgttttggttccaggaaggaggaggtacagttcatctgtaatacctccgtgaagacacgcactttggcctgctcaaccaaaaatgtggctccgaagagctgaagagtgaaggtggtaagggacaccagcctaataagtgagatccaccaaaataacctagcgatcaggagggtgacaggaatgatcgatgttccagcccaatcaccttctctcccactttggagacggtacgaactaacagcaactggcacaggagataaaagatcaagtcataaaaaggtgaaaaatgatgagaaaaaaatgacattttttttttggttcctaatacctgaatccaatgattggacactctttgcagatgttacatttggcctgatgcttggcagtttctgcagcagccactctgtgcaggacgggcagccacaccatggactggggttccagtctcatccagtctaggaagagggccgcttcgatctctggcttattattagcctgcaaagacaggagggagagagaaggagggcaaaaggatgaaaggaaagaaggcaagatggcaaaggaggtgtatatcagttcgattaataagttaaacagaaaagatagaaagaacaatggttgcaaagctaggctggcttttcacagcttgtttctgcaaatgctccctgatatccaaagagctacccactcctaaggctttggtaaactgccattactctttttggctactagatgacaagaaaagaaaacaaaaccaacaaacgagaaaggtaagcaaactacacacctgagcgagactttatttagctttaatttttgaactgatacataaaagttagccagaagtgaaatgcaggtgtttactgataaaatttcaaaggagggggacaactgatttttttttctagagaatctgtttctcatagaatcataatgaggggctttaaaattcatctggttccaaagcctcatctaacagacaagcaaactgattttgtagaccagaaaaggagcttttcaaaggccatacagctagcagcagagctgataatagaatccaaacctcctggcttagcgctgttttcatgatgccctgttgattctgtctgcctctctatttctctctctttcaaagtctaaatgtaagaaatacaattcatcccagacaggacaatgatctcaacaatctcaaaataccaccatttgatttatatgttactatattcatgaattttaattataccttgtttttttcaaccctataggattgttttaattttttatattattagatagattgacctatatattgactacttttttgctcttcattgctttctttcatctcaaatcttccatctgggattagttctgcctgaaatatgtcccttagaatttcctttagctgttggtggtgcatttctcaagctctgtttgtctgaaaatacctcctttttttaaaaaaaaaatccatattcctgatagttatcttcattaaatacaattttttttttttttgagactgactctatctctattgcccaggctggagtgcagtggcgtgatctcggctcctgcaatctccgcctcctgggttcaagtgattctcatgcctcagcctcccaagtagctgggaccatgggcacacgccaccccacccggctactttttgtatttttagtagagatggggtttcaccatgttgactaggcaggtctcgaactcctgacttaaaatgatccacccgcctcggcctcccaaagtgctgggataacaggcgtgagccactgcgcctggcccaagtataaaatttttgattgaaaggttttggggtcttgtttttattttgtttttgaatactgaaatattactccactttcgtctatctctgttgctgctgagaagtcaatagtaaagatgactgttgctcctttgcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcactcataggtgggaatggaacaatgagaacacatggacataggaaggggaacatcacactctggggactgttgtggggtggggggaggggggagggatagcattaggagatatacctaatgctagatgacgagttagtgggtgcagcacaccagcatggcacatgtatacatatgtaactaacctgcacattgtgcacatgtaccctaaaacttaaagtataataaaaataaaataaaaaaaataaagataatctatctgttttctatcttgtgctgtttctaggatttgatttagactgcttaggattcactggacttcttaaacctgtgatttagagtctttaatcagctgtggaatcttctccgtcattctctcaacaaatagtgcctcttctccattccctctccattctactttcagaactctgttacataaatgttactcttcttcaatctatatttctctgaacaggacttccctagttcccccctctctgccccacatctttttaaaacatccttctgtgcttcattcttattaattccttctgccttactgtctgggtatccatttctcttgccggtctgctgtaaacccatacagttttaaattttgattattgtacttttgacatctagaaatactacttggtcatttttaaggtaacttctcaggtttgtggttccctgtagatatttttcaatgttgttttttatttttctaactgcataaacacaattaagaaaataatctgtctaataattctggaatatgatgttatcgtaggtctgcttctatggtttgctatttcttctggttctcattcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagcacagcatatagaagttccagagttaaaccactggagttcaccactcactggctgtgtgaccttaggaaaataactttatctctctgtgtcttactttttctctgctacaaactggaaatattaatagtgcctacctcatagagttattttatgattacgtgagtcagcaaatgaaaggcaattggaaccgtgtctgacacatagcaagaatcatgtttgctattgttattgtcattattattatccatctgaccagcaacccagaagttcttggtctttgaacagccctttaaatattttaccagagctgtcttatctgtccatgcctcttcattcctattctttttacttcttcttcatatgacacggcttagtttgccattgtcatttagaaaactattcttcaaatatgattgcggagaatgtacctctatttctccagacagtgtaactggattactttcttttgttctgtaccgtaggctcacacacggttcctactcaactaaaatctctgagtcagtgtttcccagtatgtccagcagatcaatcgtccagcaaaatgcttcacgagaaggtcaaattaatgaaagaaacagtgcacattatatctgcctcttaaaattcttagagcacgttaacatattaaaagctgagaaggtcatcagtaaagcaacatgttaatcagctctggaatcttcccagattctcagagagagagagagagagagagagagagagagagagagagagagagagagagagagagagagagagagagaacaagcaagagtgacttctgaaggggcgatttaataacagttttcaattatgtgaatggctctcgcataggggcctgtgaccagctgttcgatctctccactgaggacagaacaagaagaaacagacttaagcagcatgaagaatttaggctgtagctcatatggaagaatttcctgatgctgaaagttgttaaagcattagtgtgaattaccaagggaggctgtagaatgttctactctttcaaaaaactatagattcttctatgcttaaaggttgaacattctcaaatttctagcccctaagatgcaagatccatcatgttggctcttttaaaactgctcacctacgccaactgacagactgaagacaaggtacggggattcacgttctcattctgtttcaatctttcatttttatgacaaactactctgtatcctagtggtatattccctctccttttgtctggcaatgaagaaggaaagaattaaaagccaggcaagcttctgtaaagacctaacagaactagaattaaacccagctaaaattacatttcgatcattccagaaaaaaatatatagggatagattggaatagcaggaagttattaaggtcaaaagataagtatgatggcattcactggactgagataatctttgtaagtaccattatttgttgagatacatataagtctcagatataatcccctctcagtatcaagggtgaccttgtcctcatctctaaacaccagtttcaagccatgcaagcaaaatctcttggaaaggtcatttagccctgggttttgttttgtttgttggctttgttttgcttttgctgttgttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaaccgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcatttcaattgtgaggtttgtgaaaaccatgtgaacacttaataaactacaataattagtacagtcatccctcagtatatgctaggggttgcttcctggcccgccgcagccccactcccacggggattttgctgttgagatacagcaaaatccacgcatacgcaagtcccacagtaggcccagctgaacgcatatccgcaggtttcacatctcttgagtactgcattttcgatacgcatttggttgaaaacgatccacttataagtggacccacacagttcaaatctatgtttttcaagggtcaactctatatagagaagtaaacattgggcaagagactgtgcccagtaattctcagataacaagaaaccaccatcctggaaacaatacagaacgatacctccttaatttctttcctaaattgcagattaattaaagacaggaactatacttctggagtctctgttaaaatctgctgaattgaacagtgggtgggaattcaactgcaatatgatcgcaagaaataaaaggaagattataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggaggaacaagaacaagctgtaaagaatattaatgactcttcttccaaacaatcccaatttttatgaaaatcaaatgagtgataaaaagactctataaaactatacaaaacctgcatgtaacaaataaaacagaaggaaggtgacattttgatcctcttagacacaagatacttgggttttacctttgagttactgaggaaactatagtgtacggacgcaagggatcatttacatgaggttgtacacaatggtttttcacatcttgctcttagtgtgtgtttccattcagagaacacttggtctcatgtgaaatgccacactctatgtacaagactgttttctatatcttatagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttatgttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaataccccacaacactgataaatgcatacttatatctcatctgatcaactcctttcccccttcttttcagcattacatgtccctcgtaccattagatgctacggcatgtatgagctacctggactgacaggtgcgggtccatatatattgaagtggcaaaaaggaaaaaaaagaaacaaaactctatgagcttctcaattcagcacagttttcatgttacgtgttttaattatgtcaatgtgttgttcccataaaaggattggttaatatggaaatgtatttattagacatctgtttatgtggctctctggagaaaggactttcaattccatacactgccattttaaacaattccaagacaaaaatagtatccaatggcagttcagtaaagagagatatcattctttgtacactcagaaccaccttggatgtccacagtgatattcatgaatagacgggggagaggtagaagctcttctttacataagaaaatggtctaatacatgcagaaagtatggtagaattagaaagccaccattatgcaaccaccaatattataactgaattagacaaggatcatccataaatgctaaaaccatagggtaaaaggttaaggaatggatattataatatgtcaaaatatcaaaaaattactttctcattacaaagggaaaaggatattttacaaggaaagtatcttgtagacaccaccttaacattcttagtgataccaataggaacaaaatgttattttgttcctccagattgtgatacagtggtaggtacagagcatcatcttatcgtcttttggccaaaaaatgttaacattaatctaatcacaaggaaaccatcagaaaagcccagagtatgggacattcttcaagagaactggtctgaactcttcaaaaatgtcaacgtcagcccggcgtggtggctgatacctgtaattccagtactttgggaggccgaggcaggtggatcacctgaggtcaggagttcaagaccagcctggccaacgtggtgaaaccctgtctctactaaaaatacaaaaatcagccgggtgtggtggtgcatgcctgtaatcccagctactcctgaggctgaggtggagagtcacatgaactcgggaagcagaggttgcagtgagccgagattgcgccactgcactccagcctgggtgacagagcgagactctgtccccctaccaaaaaagtcaatgtcatgaaaggaaaacaaaatgctgggagactgttcaaaactaaatgaaggtacagagacatgacagacaaaaaccttgactagatgctggaagaaaacagtggctataaggaacaattctggggcactggggaaagttcagtgtggactgcatatcagagggtattgctggattgctgttaaatttgtgtgtaacgatagcattgcagttatgttagagaatgtcatcctttaagaaaatggtgtatggtgaagtgtttaggggtttatgttgtgatgctcctttacttttaaatggcataggggaaaatgtgtttgtgtgtgtatgtacacagacagacacatacataaacagagctgagagggtggaggaggtaagtagagcgaaaagcaaccatggattgaacagatgtatgacacagatgagtgttctttagactatcctttcaactactctttgtgcttgaaatgtttccaaaataaaacgttggttggaaaccgttatttctcccaagtcaccccttcatgggaataggttgtgggcaaggcaggagggtgggcaagagtgattttagtaactgtgaaagggacaggacaatggtattaatgtcaatagtaatgagtgtgaaaagttccccaggattcgttttctctaaaaatacaaacctaacgcaaaattgatttccttcctgtccttgtcacggttcttaaagcatctcctcatcgactctgcctagatgtgcttttcctagatccctaaatgtgaatctccaggcatgaaaatgagtttaagagtccccacatgcgcagaagcagaactttttgtttaaggattgagaggtcaagagttgtctttgtgagacaagaagaagtaaaaggcttcccataactaccatcttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatcagggcgcattatgtaaaagaacaagatataaagttagctcttccactactgcctcctacaatcctttaaaatccagttcaggaaaaggcaaaattacaggaacagaaaacagagctgtggtttccagagattgggacttagtgagatgatacagcatgatggaattttaggggtgatagaaatggaaggaagaaaggaaggaaggagggaaggagaaggggacagagagagggagggagggagagagagagaacgaaagaaaagagaaaagaaagaaagaaaggaaaggagaggagaggaaaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttaaaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaaggggtgtaaaaggaatgtctatggaaccaaagggcccacagtctgattaatacacaaaaagccaaaggaaacctaagtgaaggagggtttttaggagttactttcaggatggaaaatctattaataaaatggaatcggccaggtgtgatggctcatgcctgtaatcccagcactttgggaggctgaggtgggcggatcacaaggtcaagagattgagaccatcctggccaacatggtgaaaccttctctattaaaaatacaaaaattagctgggcgtggtggcacgtgcctgtagtcccagctacttgggaggctgaggcaggagaatcacttgaacctgggaggtggaggttgcagtgtgccgagatggcaccactggactccagcctggcaacagagcgagactctgtctcaaaaaaaaaaaaaaaaaaaaaaaaaaaaaaaaaaaaaaaaaaaaaaaagtaatcagttgacccggggaatgctgtctaaccagccaaaagtctcctgatatggcattttaacatttgcagagaaacagaatctccagaatctctaaaatgcaatccacagatgatgttttgttatagataaaagcaactgttaacattggcaggatattttcatgccacaacacactttagataatcatagctaacattcactgggcaccttctatgtatccactacagctcttaagtgctttgcttctattggttcatttaatcctcacaatcacctccaggagttcaggggccaggaaggttaagaaatgtgtccacagtcacacagccagcaaatagcagagctcagatttggactcaggcacagttcggtttcaaagcctatgcacttaaccactctgccagtcacttctccagatattctggaatgctttctcatttatgtgttactgatcctcccacctcagtctcctgagtagctgggactacaggggcatgccaccatgcatggcaacaataatacattgtatatttcaaaataactaaaagagtagaattgggaatgtttctaacacagagaaatacttgttctcaacagttgagactgtaatttattctcattttcatatcattctacattattacaacaactgtgcatagatggtattcatttttgtcatacaaatagagaaattcagaagatagatggaaaagcaacttactcatttggaatactaagtacaacaggaggcagaaaacagatgtaaaataaacagattttgacactccagctctcataggtgaagcatattgaatataaagttggtatacttgacgttatctaaacaataaagtccttaaaatgtttactgaagaagatactacaaaatcgaaaccacaaaaagatatctgcactcccatgttgactgcagcattgttcacaatagccaagatatagaatcaacctaagcgcccatcagtggatgaatgcataaagaaaatgtactataaacacataatggaatattattcagccataaaaaatgaaatcccattatttgcagcaacatgtacggaaccggaagacgttatgttgagatcagccacacacagaaagacaagtatcccatgttctcactcatgtgtgggagctaaaaaaaaaaaaaaaaaaaaaaattgaactcatggagatagagtaaaatcatgactaccagagtctgggaaatgtagtgaagatcgggggataaaaaagggatggttaatgggtacaaaaatacagtaagaagaaatatgatctagtgtttggtagcacaataaggccactatagtaatcaatatatttttaaatctttttacagatagggtctcactatgctgtccatgttggagtgtagtgactattcacaggtgcaattgttgtgcattacagccttgaattcctgggcgcaagtgatcctcccacctcagcctcctgaaacgctggtcctacaggtgcgtgctaccatgcatggcaacaataatttattgtatatttcaaaataactaaaagagtgaaatgggaatgttcctaccagagaaatgatgaatgtttgagatgatggacaccccaattactctgattgtgttaccctacacattgtatgcttgtatcaaaatatcacatgtaacccataaatgagtactattatgtgtccataataattaaaaatattttaaaacatacttttttacctgttaaatgactggcagtgcaggtttgtgaaataattcttcgtgctatgatgttacaatggctacagtgtcacaaagtaatgcgaatttttcagttccattataatctcttcttacgttgatcttatgggaccaccatagtatatatggcctgtcattgaccaaaacgtcattcttcagcacatgactgtatagttttcccacctaaaagtgatacttggttttatctgaagatagactaaacagctatgttgggattagagtattttcaataaagatgggtgtgtgtgcatgtatgtgttttgggggaggggtgtttatttatctatctcattctattacaatctaaaattcatataggggatcacattgacacattaacactctgtcatttcaatctagtctccgaactggttgaagccataacatgatgtaaattgcacgatgtagactagattcattgtgccactgtgggcctgttttctcatctgaaaaaggagaggtgcagaaaatcctcaaggttccttcaggcagtctatgtgactcactgccagggcaggcttggccttactaaggtcgtaaaaatcaatctaatctctcaacagggctgtttccatggaatatgagaaaggaacaagctggcaatatattaattacagctgtatctcttaaactcgttgcaaaactttacttctatcactaccaaaatgagtcaatttcccagtaaatgtgttgactgcaatatgctattaatgtggaaacatatcctgttgcctcatttagtatctacgaagataccactgtcaaagccataaatttacagtgactattcctttttcatatccatggatgtgacttcatttcctggcttaatggataattccttggaagacctatagtgatttttaaataagcaaaattttacatttagacctgataggtgatttccttttctaagtggttagtggggagggatatgagaaaacctttaatagataatccagagagtgtggcacacaaacacgtacctctcttcttgccactactgggcccttgtctgaatcagaagattcagtacctttctaactgtaccaacctgaaacaaagtaaggtttccaggtggtgacaagaaatcaaaggaaatcaaatctgcaatgcaaggaatgcacttgtaggataaacaagtactttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaacgctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagggcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgacattttcaaggacggcatcatatgggaaatgcttttctctaaaactagtatgagggcaataagaccaatgaaaaggactggagtgtgaagtggaggcttgctaggaagccagtgcaatgatgagaaggcctggaaacaatgtaagaatggcaatggaaagcaatcaaacaaaacatgtttctttccctaaaaaaagaggcagcactttactaattttttttctaattataaatgttcaaagaagaaaactcagaaaataaaaatagtacagagaaaatcaaaagccacctgttaccaccattcatatcttgactgatttccccccagtctcatagaaaacatttcaaggctggatgccgtggctcacgcctgtactcccaacattttgggaggctgaggtgggtggacagcttgagcccaagagctcgagaccagcctaggcaacatggcgagagaccctgtacacacacacacacacacacacacacacacacacacacacgcacacacacacacatacaccaaaaaaatgccaggcgtggcggtccatgcctgtagtcccagctactcaggaggctgaggtgggaggatcacttgagcccagaggtcgaggctgcaatgagctgtgatcgtgccactgcactccagcctgggtgacgaagttagaccccttctgaaaacaaaacaaaacacatttcacatttcaaagagcttggagactggctggccaaccaggaggcattcaacaaatatgcaaggatggactgaattcaaagctttgagactgagaatacagagttgttattacagagacagaaatgtaaccaaaccagagacatgggcttaggggagtaggaggttatccagcaaaaggatgtagcaggcagaaatggaataggttggtctcctgataaggggggcagcccagggaaagcagagcttctgtatggccaccgcttatcctgacaaccaaatccaagagggccagaggctgcagtgaggatggtggtggcttcctgatgagtcagtactcgggcgagaaaacaaagaatccagctggccctgaatacagcctagtttactttgcagcagggaccatcactgagccttacctttaacccaagtcacaatgcacacacatatgtttatatatccctatatatgaacacgtgtgtgtgtttcactagaactcaaagagtaactgagacttgactaaaggggaaaaatgattaggacctgtaatcccagcactttgggaggccgaggcaggtggattgcttgagatcaggagtttgagctcagcctggccaacatggtgaaaccctgtctccacaaaaaattagccaggcatggtggcaggcaccctgtaatcccagctactcgggaggctgaggcatgacaattgcttgaaccagggaggcggaggttgcagtgagccgagatcgcgccattgcactccagcctgggcgacagagggagactccatctcaaaacaaaacaaaacaaaaaaaacacacaaccaaaagattaggaaataactcgcgtttatggcaagttgttttataattggattttaaaaaatcaaaatgaacctagattgcctgtggccattaatattcattgtatggaagttacttgtgtctacattttgatgattgattggattgatcatctatctgcattttggaaggtttgggtatgaggaggaaaagatatttatttctccacatgcattttacatttacaactaatttgccataattttggcaaaataattcaaacagtatatcccactttacataaatgaacttattatgtgtgcatccggtaaatctatccaactaactattaaataaatactcaaactgctttaaacacctaaatattcacagtgatctgcccaggaaaccttctatagtttcatcctagtctgtggtcaaagacttcagatataacccagttagttctacagctagttccattttgtaaatctcagccattgttaatagaattagaatggattgagaaaccctacataagaaaaacagctcttagcacttgaaaaaaccaaaaacaaaaacataagaacactgtgaataatgtgataccgaaagcatcttactccttcaatactgatagcgttacaattagaacaacttttgaagaaaggccacaaaaaatgtttatattattttgtctggcaatcacacgcctgagaattgatcctataaagaaagcttcaaagacaaaagctaaacgataaggatgttcattgtagcactatctacctaataaaaattagaggccaggcacggtggcttacgcctgtaatccgagcactttgggagttcgaggcaggtggatcacctgaggtcaggagtttgagaccagcctggccaacctggtgaaaccctgtctctactaaaaatacaaaaattagcttggggtggcggtgggcgcctgtaatcccagctactcgggaggctgaggtagcagaatcacttgaacccgggaggtggaggttgcagtgagcagagatctcaccactgcactccagcctgggtgacagagcgagactgcaactcaaaaaagaaaaaaaaaaaaaaaaggaaagagaaaaaaaaattagaacaagatgaatgtctaccagtggagtgctcaggcatttgggaagaagagggtgtttctggggcactgactacgacagagaaaaagcaatgggacaggataggaaagagaacggacaagagtgtgttcagtcagtgatggacattagcagagagtatacacctctagactttggaataataggggaatgtcaaagctacaaaggacagttttaaaaaaaaggacagctgtgctaacaatttaccaacagccattgaaaggaggctataatgatagaattagagaaaggactcagagactaagagactcgcctacaaaggccattttcttatatacataggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaattggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatctggatatttattatttttatgaatcaagttaatgatcactgtatatatatgaagtgtgataacttttacataaactgtgtcactgcaagaagcgcaagcttacacgtaccctcgacacttaaatttcttctaagccagaacataatccttgggaattattgtatataggatgtaactacatcaaaaaataagtgttttagcattaagagacatataactggcccaaagcaccaccctccttggacaccagagattcaaaaatgtaccacagttgggacttctttatggagtcataagatcactgagcttctagtccatcatgtatgtgttcccacaggatactgtgcatagtttgttgttgttgttgttgttttttgagacggagtcttgctctgtcgcccaggctgcagtgcagtggtgcgatctctgctcaccgcaacctctgcctcccgggttcaagccattctcctgcctcagccgcctgagtagctgcgattacaggcacatgccatcacacccagctaatttttgtatttttactggagacgtgtttcaccatgatggccaggctggtcttgaactcctgacctcaagtgatcctcctacctcggcctccctaagtgctgggattacaggtgtgagctactgcgcctggctgcgtatttctaattaatagctcacatcatgttatgctggcattgattcaatatgtgtctatcgtttttggcaggagacttatatccccttgagggaaggaaccatatcttggtcagttgtgtgccagaagtatctacagtagaatggcagtacccggtggatagtaggtgcccaatatatgtaacagaatgaatgaacatactgaatgcttgcaatgttatgttttgttctcagatataaaattttaatcataccttatattcacctagaagttgcccctcaaaaaaagtaaatccaagaaagctttctgtacccataagcacactttaaactctaggaaattaaatgttttaacaggatacctaagatggcactaaaaattgagattgtacgcacagctttttatctgctctccgatatacatacctaggtgtttattttcaaagttatgagttactttcaaacatctcattttgcatttaatatttttgtttcaccaacctaaaaacatgttccctcttagtagttattcgaaacaccaactcaaagcttcctcaattattcaatttaatattatatttacaatgtgctgtcactataccatatatacggtagattagaacctaacctatactaagtaactacaatatttaaaggagaaaagcacacaggtatcccatctcatccgaaatacattttaaaatggttaacaaaagctgttcagttatttttctctcgttctgaggatgagaaaactcaagtggaaactacataaaagtgagggccaaaatggtttgtgtattttgtggcttactcctgaaggagaaatgatcagtaggagacagagtggcttttatctcctgcctgtcctgaagcttagcacatctcctcacatgtgtggctaggcctcaggggaagagagaaaagacaagctaggctgaatttgtttaatattcctactgaaaagattgcttataagcatttcaaggggaaaaccaactgcagcctttcacaatatgaatggatggtcacttggtcatctgaaccatcactcctctagcattggcttttaatttggttttacagtttttaagcagaagaacccaatgcgtaatcaaaaggaaattctgtagggtggtacgtatctatcctttaagaaacagcaagctatctgtctctcaaataataaaatgttagtcacgtcacggaattggatgtgtcagtacaacttgcagtaagatgattataaaataaacaatgtttcttgaacatgaatgtcacatggtattctttaaataagaacccaaagactagacaagtgcagagattaaatcttcacacttatttttccgacttacagaaagaggttagaaaatcagactttatcccctaggaacatgtgttttattcagacacagtcaatgtaatgtaaaataatacctggactggaaaagctaatcctcattctctacttaaatgcctgcaatttaatgtttgacaaggaatggcacaaaccaaattttatgacactctaaaagcagttctacatcttacatgaggaatctgctgtcaaataagaacagtctgtcatttcccatctagaactagggtaattagccaacattaataaaagaatacagcattaatatacacgacttacatctgtacttgtcttccaaatgtgctttacacagggaaatgatgccagttttaaaagacaggacacggatcctccctgttcgtcccctattatgaagaatcaaagcagaaaacaattactgaccctttcctagagggtaaacacttctagttaagaataaagccttgaaaaggaaaaataaaggagtaaagtgctcaatgatgtgtgaactctattgaccactgttttattaagattgttttgaacttttccaaattcattatctctttgactgatgacctacaatgcaatggaaattcaaccaacttgaccactgaatgtttaccaagtttcaattcctaaaaacccttatttgaactgcaaaagttctacataaattaagaaaaaaaaattctattcacctatggaaagccaccttggtttaagttggtaagcagaagaattactaatcttcaccaatctactttggttactaaagcaaattacctactttggtcatggaagccaaaaaaattaccagcaactaactgctcagccctcttaaatgctcagatcttcatcagattgccccttattgaaagaaaattaattacttcaggccacataacacataatatagaatataaatgtttatctccgtaagaaaaatatcatactctattaaacaacattcaaatatatgatctaaaaaataaatttataaataacctgttgctatatcagtgttttaatatagattgcttttatttgcatagcattttctatatttgcatatagaaaactgaaataaagcatttcacataacaaatttattaataagctaattttatccatgggggaaaaaaaggaaaaataagaatgaaaagttttccattttgtagaaaatgtctttcaagacatggaatcaatatgaatgcccatcaatgagaaatatggtacatatacactatggaataccatgcagctataaaaaagaatgagatcatgtcttttgaacacggattagctggagactattatccttagcaaactaatgcagaaacagaaaagtaaatactgcatgttctcacttctaagtggaagctaaatgatgagagctcacgaacacaagggaacaacagatactggggtcttgagggtggagggtggaaggagggagaggagcagaaaagacaactgttgggtactgcgcttaacccatttatgctggaggctgcatattactttttgtgaaaatcagaccttggcgatgaccttgagcagtaggataggaataattcccacaagcttagtgttccaataatggaacactaggcataaatgggttaatacctgagtgatgaaataatctgtacaacaaacccccgtgacgtgagtttacctatgtaacagaccttcacataataccccgaaacctaaaattaaagttaaaaagtgtctttcaatagttttttggcttcttattttattacggaaagctactggcccttagatattggtaaaaagaaaaaggagaaaatatttcagaataattcgcctattagcacttcaaaatcacaaaggataggtcccaatggcggttattttcggtgaacaatatgctcaacttccagctactaaaatttattaaatccctcagtcaaaaagaaatcctgggcactaatggactaaacaaattcctatcactggaaaattttcttatctttctccctcttaagaaaaggtagatcaaaatttaacaaatccactttatacagcaactcaggtcttcaaggagttaaaattgtcaccaaatacttttcagtcaggtagaaggaagttatacattcagaatgcattcacatgtcatctgcaaagaaaacagtgccaaaatatatttgaggggaaacctgaatacaaactcttatcaaaactaatgtgaacgtagttcacaattgaaatccgacatgttcaaggacttggtagatgactatgatgaatgtaatagtcaggtggtcctgaaattttaaaaagcaataccttatcaaaataagaaagaaaaaaaggtataaattttagttcaaaaggtagtagaagtctacaacaaaggtaaaaggcaaaacagttgttttgcaactcttttcagaaaaccttcccagatttccaaatgggagtatgttcttgattggtgaaatgaggcatgtaataattttgagatctaagaagaatttaggcaaaattaagaccaattccttctgctcccttcttcaattgtcttcattaagctcaagaaaaaaaaaaatcagaactggggatatctcccttgtgtgcaatccaaaacaaacaattgttctctaagagagagtgatgaatggaggcgccaaactgaaacttcataaaatcttattaaaaaacaaaagaaaacgaaaaatgttctcagtttgagaagctaagtttgctgtattaagggcttgttttcattttgtttggcctatcaattcataatcttctgcaaaagtgtcctaagtatcagctaagaccattctgatctggagacaggtgtgccagtatctccaggagcacagccatggccgccagtgagaggaagccacccctgaagtgcatggaagaattccaaaatccatgggcgagaaagggaaagaaccaaaggctatatgtcgactcattccactatttgcaaaatgagtgtctcagggttttgtttgttttctaatctgagagcaatctacattctggctcttaactcctagcttatcaaaatatttttcaagtcataaatgcaaaaatgatttatcacaggaagagcattaggtccacagcttccagggccctgttgtaatgctaattacacttcaccattctgtacgctaagcctcctgtgacagagcccgggaaataaaaacatgccatacgtacgtatcataaacattcagcagccagttcagacacatatccacgcagagagggacgttgaccaaattgttgtgctcttgctccaggcggtcataaatagtggtcaaacaattaataatctgcaggatatccatgggctggtcattttgcttgaggttgtgctggtccaaggcatcacatgcagctgacaggctcaagagatccactgcaaaaaacaaataaaatcacaaatgactcaaagagtaaaaccttcctttcagtgtcctttttcctctgagaatcctagctaggactctctcataccctttaataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcattagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagggaggaaaattcccttgatctgaggaggtgtttaatcttatgctggggacaaaaatttaacaaaagtgaaacttcaaccttgtccaacatcagcaaatcacaagctttattcccaagtgtcatgaaaagatgcatttctctaaagccaatttattagccaaactagaaacacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccattaaatatattatatatatatatatatatatgtgtgtgtgtatgtgtgtgtgtgtgtgtgtgtgtttgtgtgtattcactagtagatatatctttaaagctacataaaaacccaagtattctaatacatcttcactttctaaattatgtttacagtagaggatgctataggctttgaagccattgaagaacagggaccatgtggtggtaccctatgcatgagggctgtgggggtgagagagggtggggacaggataaaagaaatggctgactctccaggatcctctttgctgtgcaggaaaagcagacagtggcggttggggggcggcgagcaggcaggacttcaacacagggatcccactaatggttcctgaggctctggttgtgcctaatcatcttctcaaccttctagcttcaaaagctcattcttttcctttctatgtatgccacagtagctaactcttgctattccttcctatgtaagacagattttttttgtcttttacagagtgatagactcttagagccagaaggttgctttaaaatcattttgcagttgagacaactgagaccagagatatggagactcactctgggtgttatggcaggatatctaggttttctgatttctcatggaggtacatattgtaagggggaaaagtgggtggcagaaggtgtccttactgactttacagaacaggaaaaccattctgcattccatgctaatgacaacagtaggataaaacagaagcaccaaaaagttggttagtggagaaaaaaaaagtctcatggtgcccatataaccccaagttcatcctataggtcaatctgtatattctatgttgatgtataaataattctgtgatctaattagcacagaaacagaaagaggtgagtaatggtggaagaactgctgtatgtttgctgatttttcttgcccaggcatgccactctacaggcaacttacacttatggctgagggacctcccaagcaaatctttgcacttcaagaaagtcaatgcactttgatgtagttgtctgtgcagtaagggttaattccagagaggctggagttggcacgagatgacttgctaaaatatctacacagtgcagagccctggtcaaagcacttgcttttcaaagtgacttactgtgttgaagtgtagccatgggttgcaggttatcaccattgtttattgctaacagtaacattgaccatttttacccgggcacagtcagaccaacggaagccactgagtttgaggctggttacataggaacagtatgcctaggttacccacgggatataagaaaccctggctgaaactccaatttgtgctccctggtttccaaggtgttctgtgctcacatcagtagctcttgttccaagagagaaaatgcatcgtggtgtggctcttgcagacagagggcaattatagcttgcacctgtcctctctggaccctatgctgtgaggcaggctgtggctgtgacacttattcttgttttaatgttgtgggtatattgcatcctttttctgcaaggaactctagattcgtaagcactgtcatttggttcctgtgagtcctctttagcaattgaaccctgtttaacttccactgtcagggcagtgagtgtcagaagcaagattgtttagaacacctccaactcattcttagctaaaagtatgactgaggcattatttagaaagaaaaaaagaagattctgataaaagggatgaaaaagaacctttgaagttgctcaacaagctacgcttggttgaaaagtaacacaggctttgaaattggttactgatggtgtaactttctagtggaatctggaagtgagagaacttgaacctaaggagctaacaaaatggattaggaggcaattgcaaactgatggcaaggctgctaaaaaaaaatccaaaagctaatgttaagttcagaatttctttccactgggcttcaccctctctggcctgcaggtggagtcccaaccaaaaagctgaagcaactatcatttttgagaaatgggctacacctgtgagaccagttacaattaaaaagataattcaagtggggcacttacaggtattccctatgtcactacaggtttcttttttgatgccagacctagtagtccctgaactggggctacaattaagagtttcaaaggctggtaatattccaaaataagatactatggctattagttggtacttaagcacaagcattccacaaggatcaatggaatggattactccttccttgtgccttgcctaattgaagctatcacacaaccccatcataggttgaaaatatcttaagtcacaaatgcatttaatacacctaactaactgaaactcacagcttagcctagcctaccttcaatgtgctcccaacacttacatcggcctacagttgggcaaaactgtctagcaacaccttacacagtaaagtgtcagttgtttagcctcatgatcttgtggctgactgggagctgaggttcagtgctgctgcccagcaaggggagagagtatcataccgcatattactagccttggaaaagatcaaaattcaaatctagaagtagagtttctattgaatgcatatcactttgcatcactgtgaaatcaaaaaattgttaagttgaaacttcacaagttggggactgtctgcattgtgtggtgtgtgtgtgtagctggggaagaggtttggcttaaaattaatgataaaaggaaaaaggtgagattgttgcaaggggaaggaaaccaccaaagatacttttttatttcttttttcttttttttttttttttttttttgagaccgagtcttgctctgtcacccaggctggaggacagtggcgcgatctcggctcgctgcaagctccgcctcccaggttcacgccattctcctgcctcagactcccgagtagctgggactacagtcgctcgccatcacgcctggctaattttttgtatttttagtagagatggggtttcaccgtgttagccaggatggcctcgaactcctgacctcgtgatctgcctgcctcggcctcccgaagtgctgggattacaggcgtgagccaccgagcccagccgatacttttttttttttttaaagggaaaacctaatataatgttgctgcctacggagaggtttaaaataagagaataatatgctcccttggcttagactcagatgcctcttggggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatcaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtgtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgagaaagacttcctagtgcaagaagcgcacttcaagggcatccaattccaggaggaaggatagggatggcaagctgccaaggttgatagctggagaatggaaccaataattactagaaaacggaacctacgaggtgttctttaatctctttagcatctgactgagagaaaaccattctttccctagtgggtaacagctaaacaagattacagtatttcccctgggagatagatgggtcatgttatgagacctctcttgggcactaatatctgtcaaaccatataaactgagaaaattagtttggccatgtcctcaagacgtcttaaactcagaactaacagagacatggcctctaacctatgtgaaaaataatacatggtatatagaaaaagtagatttttgtaggacagtggcaaaataattacactggcctctcgagacccccttgctgtggaggcagcctgtggctgtggatccatatcctgacagtaatgctcttgtaatgtagccttttctggcaatagagcgcggatttgtaagccatgttattgtgggtcctgagagtcttctttagcaactgaagcctatctaatgtcacccttagcgcaccatcaaaaggtgaggtgcatttacagagaaggcggtgcatttttcacctggtttgtcatggtgagggcgagtccagaaactgtgactattcacacaactccagcctgtaccaaatctctataatgtgtgctttagttgctgaatagaggcaaaatgttctctatttcttactgtttgcagaatatttgtcacacttatcaactgcagtatatttagccctatggtttgggctctctccaacccaccacacattattaataaactaaatacacttgctttgttaagtgcgtttttatttctgctcttacaagttggctttttaattttagaagcctcacacctgtagaatgtcatcagaactacaaagggagaaagaaaatgcttaaattaccttcttcataactttcaatggagtatcagctatatgaaacagtttataaatccttcttaccaagattttatctttgttcctgcttttctaccaagtttcattttcatttccaatgtgttgagaggcagtaaggagtcatgcaacacttaactgattacaaactggggacattataggccaacggtgatgctctccacttaaatagtgaattctctatagtggatacaattgggttatttggctttctgcaatacggaaacattgatagggaagtgaaaaaaaaataagatcaagtgcttaatagaggtggaagtgcatatttccaaggcatctgtaattcaaactcttcactggcaccaggaaatcactgagataacatcattaattttccttaaagttagagttggtagaagtggcctttggtagggaaagctagccagggcaagttttatttgcctgtaccgcagacaatagctctttatcatggctttgcaggcttagaaatgacaaaagcctggaagctaaatctaagcaaatataaaattaggagaaaattcttaaatcatatattgaaagtaagtaatgtgaccacacatatgttcaataaaaggatggggtgaactcttcattctatagttttactatatatggcaccctcctagcattaatgagaattcaatacttaatttagatacatacaccttaattttggcatacttgaatctttttcacatattagaaaagccatgctcagaaaggaaatgcagagaatttcaaattgatttaaaagtgaaaatttaaagaaattattctacattcggagcttacctttattacaaggttatcacctcaaatggacaaaattttgtatattatgaaattcccccattttcccaaagtttattggaaattataagttgaaatgacagacaataaaacacatatgtgaatggaattttttttgagcaggaaaatcgaataatgcctaaatccagggtgaaaatggacattatagaaaggaacagtcattataaggtttttccatctggtctatttctgggtttcttttttttttttttccatagtataaactggaacaaatggttagcttctgaacttttaggatctcacaggaatattctctagcacttcatgataaccagtgcctaattactcctttattaaaggaaagcagtagctctgggatggggcaggggcaggggcaggggcaggtgaagaaaaagaggcaagaaaactttctctattcagccccctgactcgatcccatcccaaactactttttcccagctatgacgtattaacaggtcctaaggaaaccctcgacctggaaagccctttaaacaccagttaaacttggcaactatatagctgaaaaatgataacttcgggctataaggaaatggaagccttggtttactttcattcatgcattcatctcatgaaaacatattgaaccatgctgtgtgccaggttttgtactaagcattggggataccaagatgaagggaaaaggcctagtctctctttccaaataattccacttctaaggcatttcttctctatctctgtgtaagaaccatatgccaagtgactccttgactatcttattgctagcctctgcagatcctctggttgaacccctttatttctgaagacctggcagccagggttcacggtccttctcttttgcccagttctcgctccaattctgcatgatttcaacattggcatgggggactcatgcatcattctagcctctcagttccttaacttgctatttcacctccatggaaattcacatccactctacctctgccacctactcaaatggctatatcctagatctaatcacctgaaactgttccaccttcaaaataatgttcatctatgattctctctgaccacaacttcttgaccttcagttcctttactacttcttcccctacctccctgaagagttagcattttcatccctctacctcctaattaccagtttccatatgcgttcacagcttctcctacccaacagggacttgtcagtatcattttaatcaatcttttgcccaaatcctcacttctcttgcccagctgttccctccctaccccaggacagaagcatctggctcccaagtgctaagcgtgcctggggaaataccacacccctgcagattggagctaccgtgaaacactcagccgcctctgggttcacacagctggttttcaactccgccctctctcttattctccacaaagataagcccaacttcatcatctcctgctgttaactgcgttgcagggactctccactccatacaaaaaatggaagcctttatagtaagacatccttcaccttgctgctacctggtttcttagttacctggacctgcccagatccttccctctaccccacccattacagtggaagagaggtatctcttccctcccttgggctctggattacctgcccgtattctctgagaacacccattatttatcatctcctcttgggccaataattgtaatctcaccctgtcttctcatactcatataaatacattcccacgaatactatatgtttggcctgcatttgattgaaaaaaatccacgtaagttgacccaagcagttcaaacccatgttgttcaaggatcaatgtatacacacacacacacacacacacacttatatacacatattgtgccacataatgacatttcagtcaacaatggactgcctatatgacagcgagcccatgagattacactattatatatttttactgtatctttctatgtttaaatacgtttcgatacacaatacttactattgtgttccaactgcctacagtattcagaacagtcacgtgctgtacaggtgtatagcctaggagcaataggctatcccatacagcctaggtgtgtactaggctataccatctaagtttgtgtagtactctcctatattgacataacaacaaagttgcctaacaacacatttcttagaacatatccccattgttaagcaacacgtgactgtacatacatttccattaactcctcagccccctccaactagctaccaccccactcttctccccttcataagtaaatttctccaagaatcattcataccttctctaattctccacttttggttcacttttgaactcaccacaccacttccactgtgcctctaaaatctcaccaaagttactagggaccttcctgttgctaagtccaatgggcattttccgcaactttatgctgacatcccagcaacatctgaccctggtaacgggttctttctttcttcccatggagcatgtggcatcataacctcttggaattttccttctttcctcctggccattcctttgcagtcccttctgtaggttgcttatcctgtgtcctaaataacttcccttctcacgctacactttcctggagctatccaatcctctcccccgttacaagcagcacctacaggctcatgatccctaaacgttgtttgtatatttctcctgagcaccacagctccgtgtctaaccttaccagacaagtcccacattcacctgatattccaagccaagcacctaagtgtcttccttgactccctttcacccaccacatcaagcttgtccaacctgtggcccaggatggctttgaatgaggcccaaatgaattcgtaaactttcctaaaacatttttttttttttttgcgatttttttttttttttttttttttttagctcatcagctaccgttagcgttagtgtattttatgtggggtccaagacaattcttcttccactgtggcccggagaagccaaaagattggacatccctgcaccacatcaaatgaatcactgaggcctgtcaaatccacttcctaaatatttctaaattctctccacttatctcccttactactctgctaattcaagccaccacattgctggtttagattactgcaacaggtttttctcctgtcactcccacatcgcaccaatccatactctgttccacagcaagaatcatctttctaagcgacaatctgattatgtcacccccaggccaaatcccctgacctctaaattccttaacttgggttttaaaaaccttgcacaatctgcttcctgcttctctctccagcctattatttcacaatagatctttcccctggaattctgtgctttagccatactgacatattttcagttcctgaatgtgtcatgctttctctgggcccttcagcacatgctcttctttctgactagaacgctcttcctagagagagagctgcttactcttctagagttacctagcttagacatcacctcttcaaacaaacattctttgaatctcattccacacagttagctgttcacatagtaccccattgtcccactgttgcacaactaaatatatgacattgaaatggtcttggaaatagagacaagatcactttatttttttaaccaactgtagacattcttaatacattatacatatatttgcttatgtctacaaatttcatgaacatcctggttatcccttgttagactgtaagttccatcagagcagaaactgtgcctgttgggccgggcgcattggctcacgcctgtaatcccagcactttgggaggctgaggcgggtgaatcacctgaggtcaggagttcgagaccagcctgaccaacatggtgaaaccccgtctctattaaaaaatacaaaaattaggccgggcgtggtggctcatgcctgtaatcccagcactttgggaggccgaggagggcggatcacaaggtcaggagatcgagaccatcctggctaacacggtgaaaccccgcctctactaaaattacaaaaacaaaattagccaggcgtggtggtgggtgcctgtagtcccagctactccggaggctgagccaggagaatggcgtgaacccgggaggtggagtctgcagtgagcctagaacgcgccactgcactccagccagggtgacagagcgagactctgtctcaaaaaaaaacaaaacaaacaaacaaacaaacaaaaaacaaaaattagccgggcatggtggggcatgcctgtaatcccagctacctgggaggctgacgcaggagaatcacttgaacctgggaggtggaggttgcagtgagcccatattgcgccactccactgcactccagcctgggcaacagagcaagactccatctcaaaaaaaaaaaaaaaaaaaaaaaaacagaaaaaaagaaaaagaaactgtgcctgtttcatgggcatatcatcaatgcacacagaccctcagacaatagtagagttatacataaactatttgatgacatgatagagctgtgtaacacttcaggatttttccacagatgtatgataaaaaaggaggaaagcaattctgtcatttttcctctaccacttcattcatctgcacgttagcattcaagctaataaaccacacatgtctatgaagtttggtttagatcagatagtcatagtcttctaatactaagtacattttgtaaaaagaaaaaaaaacaaaggtagaacaaggattgtgcaagtttcacaaaggtaattatggatgccgatgccaatgccagtagttggaaaataaaaattctcaatatcttaattcaacatcagtagctgaggaatggtgacaggaatgattctaaaaataaaacaaaacattctaggcaaactctaggccaaggatacattaaagaatgaattatacattgcaacaggaattgtgacagctgtttctcccctctctaagtaaaaatgtacccaacctactttttattctaagcaaagacatagtatcaagatcttcaaatactggccaatacttacagcaaagggccttctgcagtcttcggagtttcatggcagtcctataagctgagaatctgacattattcaggtcagctgaaaagagggaaaacaaagagcatttgttattccatcagaaataacagacaacccacccccgacgcccagtgatttgccaataactacaaccaccacaaaaatagcctagaaaacatatagtgtgtatacgccaagctttcggaggtgaaaattctgttaacgtggggaaaagaaaaaataattccttttgccctttgacaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataaatcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgtatttaaaaatataattaggaataaaataaacatttggctctatattctaaggtacaatcattctaatgttcagcacagaataacaacaatatatgttactgtggtttctgcagtcaccggtctatcaagccctgactcacgccacctagcaggaagctatatttagatgatgttcttactcaagtctgcacaagccttgatagatactgggctacatttatttcaggaactcagctccaaaaagctccttgaagacaagaactctgtcacctacttctgtcatttttcctagcaacttaatatgcaactgccctctgaaaaagctgttttaatacagatcatggaccgactgaccaactgaatcaataaacaaaagaatgaaagaaagaaaaagtacactgacatacatgactgccataatcaaatgacacctacgaaaccaattctgatgaggtgttaggaaagggcaataattcaatccatatccaagtcacttgggtcaacattttcagctttatggccatcgcagagaccaaacataaaagcctgaatttcaactaggggaaagaaaacaatgtctgtaatttaaactattcagcatacaattttgtttaaaagaccggaataccaaatgttggtgaggatatggagcgactggaattctcagacactgcttgttgggaatgtacgacaactttgggaaaccagttaggcagtttcttatgaaattaaacacacatgtatattatgactcaaatattcttttcctggatatttgcacagaataaaaaaaaatgtatgtccacaaaaagatgtgtacatgaatatccatagcagctttattcataatagtcaaaaaccggaaaccaaccagtaaggtaatggataaacaagttgtggtaaagtcattcagtgggatactactgtgcaaagtgcaataaaaaggaactaactactgataatgcaacaatgtgaactgatctgaaaaacactaagctgggtaaaagaagccaggcacaaaacagtacatactgtttgatttcacttatatcaacttctagaacaggcaaaacttagctactatgccagatggtagcctggggtgtggtgggagtaggtaactgacctcaaaggaacacaagggtgttttctaggtgatcgaaatgttatatcttgattggcatggtggttacacgagtgtatacatttgccaaaatctaacctgaacacttaaaatggaaacatgttatagtgtttaaattatgccctgataaggtaaattttaagagtctttaaaaaccctcacatgaacagtacactctgatgtatgtgtgtgttagcttaagctacactgtagaggtggtcagttgtcttaatcaggagtgaactccaagggtggttggctagcaattaatcaaaaagcctcatgccacaggcggccactgtaagtgattcagttatatttagctcttattacaccaggggtttcattaattttcctaattaatagttagacgggcctgtgtagtgatattagtggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggtatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaactacatctaaccatgaatgactaccaacaccaattacagagaacctgtgtgagtccttgttagtcaaagtgtgatttgaggaagaatagcatcagtatctgcttggagcttatgagaaatgcagaatctcaggccccacccagatctgtgaatccgaatcaatattttactaagagcctctggtgattcatatggaagttctttaaatgaatattttaataaagtttcttgttccgtgttgttaaacttcaagtataaattctgtataccaacaccatcctgtgttgtcttttgtttttctatctttctatcttccattttgtgggcttttattaatagattatttaataactactatagtcaactacaccaaaacctcccctctgggatatatttgtgagtctcttgtttatgataaataccaataaaaagtattcaataaattaaaagcatctcggagtatcttgaaatgctatatatacagattgcttcttgaagataattaacatttgcctggacgctgtcctttagtgagcagaacttgatctagttgagtccctttaattgtccttctctctctctcccctaaaagatgtggttcttcctttgtctcttttgcccagtcatcactgcttacttttttaagtggtctcagccaactcatggtatgaattgtcttgcggcatcaatccatgagaaaccaattcctgtcctcccctccagattggtgcaacatccttcaccagtaccatcaaatttttcctgtacttgctagtgtggagttcccttacacacacactcatcattgagtccctttgactctttataaaaagaaatgtagagacgtggaaatgcacttttggtcaaatacagatccctttcccattaacaccagcctgtagcagtttccaggggataagcatccaatcccaaattttctctcattcctttacttatgcaaaagtattgagtgttagttttgtgccagccaaacatcttgtagaagatattggcataaagtttctcttctttttttccctttctaatcctccttctccactgcctcgtaactcatgtgcctagtttcctatcatctttcttctttcaaagaacgacgattcctctcttatgaccccaattctaccctcttttcctattttcctggttctattcagcatttagaacaaatggtctaaatgaggtcacaagctccatccaaatcttagcgttcatatcaagaattggcaaattccagtagctagagatccaagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcaatgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagtgggggggatagcactgggtgatatacctaatgctagatgacgagttagtgggtgcagcgcaccagcatggcacatgtatacatatgtaactaacctgcacaatgtgcacatgtaccctaaaacttaaagtataataaaaaaaaaataaaaaaataaaaaaaaaaaaaaaagaaagtagcagggcaaacgtttagcttccatcacaatgctacggaagccatacaaatgtatatctggtaactgtcagtgaactgcaacggagttctggtgccctacaagtctactactcaagagagttaactgcctgtgttgtttgagtccgcatgtgttgctaggagtctgcagcaccactccctccggcttacagctggaagagataagtctctgccttaggaaagtgtgtaggatgcacacagaaacctcaagatgcaatacagctgtgaacaatgtgacactgtcctgggctaaagcttgggatgactgtgtagtgaaagtatgtatgcagtttaataaagctaaagccccccattcccgtgccccatgagagactgtcctccactttccctgggagctgactttccaggactctgatccaagttgtaatgagctcactagctctcacagccggaactcaagaggagtgagactatccaagaaaccagttacgccatgtttccatggcagctgggagaaagcgcacttcagaagggtaaaaatgctgaactgcacatttctcttcataacttgtattattttatccagggctggttctagcctataaatagagaaatctagaaacgtaaggaacaagggcaaacatcaaaccacctaccttctcaagttgaatttccaactactgaagtgataggccattcatcttttattttgaaacatgaaacaagtaataggcttctcttgcccctttgtttagtctatgcatttttcttgactttggtaagtatttctgttttatgactttcacttttactctgtgtaatagtagcaggtgtcaaaattcaccagaaaagaggaacaactggtcaagtttgcgtcacatatctacatgttacatgcttttgaaaaatagtgagaaacacctcagcattttaaagccatggaagcattccaaagatattacagaaaaaaaacattaagtcccttcatttcaattttatagctggtttctgtctttttaataatactgcaaaaatcctactatctctgactgaactgaggtctagaatttaaaacaaggagtgttttagtctatctttccaatggcttatggagactttttggaaaggcctaaggtttcaatatgcctatctattagctagaaagaacaataatgacctcattaactttatgagtggaaagagctgtacggctaaatgattattccaacagataaattggtatagtggtctttgtttcttcataccaactctatttcccagaagaaatttaatccaaatctcccaggtggtaagtgaaaaataaaatttagagcacatatgcttttgggggagtattgttctaaattcagtgtttggcatacaatacgcattgaactactactgcctgcctattttactaattttccaaattttcccaagaagccaaaacaaggcagtctccccacatactcctattatagaaaggtggcatattttaaaatataataatatgtctccaattttccagtctcactcctccaaaggattctaatggacttttcagatgacaagtattattcttgccagctcaaactcactagaacagacaagaaccttggatcttaatgagacttcagacaaattgagtaatttaaatccagtctgtcttgaaagcaaattaagccaaaatatccaggcttcagaagtctagaattattgggagatcttcaagaacagaccaggaattctggaacatatctttaaagaattagctgagagaagaggaacactaacacatcatacttggtctataattttttagatatatttgaggcctcttaaaatctcaactcgtaaaaacctcatcatcaacatagagctttacttaaatgggggaaaaataaacctacacacagataaacaggaattatgcattcatacttagataagtacagaaagtacagtctgtgaatttataattactatcaagttatgtttccagatgtgaaatggtattacttatttatcaccaatgactttgtaaaactcttctaagaaatgaaggagagggccaggtgtggtggctcacacctgtaatcccagcacttatggaggtcgaggcgggcggatcacgaggtcaggagttcgagagcagcctggccaacatggtgaaaccccgtctctattaaaaacacaaaaaaattagccaggcatggtggtgcacacctgtaatcctagctactcaggaggctgaagcaggataattgcttgaacccaggaggtggaggttgtagtgagctgagatcgcaccactgcacttcagcctgggcgacagaatgagactccatctcaagaaaaaaaaaaaagggagagaagcaataaagtacctagtatggcacaaatgtggaagactcagaattgaggaaaagagaaaaaggttatgaaccaaaaaatactgagaagttcaactgtgaaataaaagatagcacaaaatcctggctgtggattgtttaaggcatttctggctccctcctcttgcttggccttcctcagcagaatctcactacttcttagcaacactgtaataatggcagagttgaaattcaaattagttttgctcattgttagctgccctggtaaaaggtttgttgagaaagcagtttctgtaacaaatggccgatataaagttttctgggggagaactgtgtatcttaagtaccatttctggggcctgaattctgccccagataatggagggctgactcatataggcaccactgtgccatgctcctttaaatcaagcttcaagagcggaaggatcagggctctaactcccaaaaccttcattatatataaaacatacaatccataataattatggatccataaggataaatgtcttctaaaaagctacaaagcagtgttgcctgatcttttaaaaatcattagtattattttaatatataacatatattattttaaatacatttaaaatagtacaaatgacatatttaaatacatattttatatatttataacatatgtgtatttaaatatgtatttgaagtaatactactgattaaaaaagactctttaggcagaactgttttataactgcttaaaagacattcatctatccataatcctttcatctatcctttcaatatttattgtgcatgtactataagccaagaaccatgccaagtacatggaatacactggtaaccaaaataaatctctgcctttattgactttgcagtgtagcgaaggagatggataataatcaaatattcatatgtaggccaggtgcggtggctcgcgcctgtaatcccagcctttgggaggccaaggcaggcagatcacctgaggtcagaagttcgagaccacctgggccaacatggcgaaaccccgtctctactaaaaatacaaaaaattagctggatgcggcggcaggcacctgtaatcccagctactacctgggaggctgaggcaggagaatcgcttgaacctgggaggtggaggctgcagtgagccgagattgtgccgttgcactccagcctgggcaacaagagcaaaactccgtctcaaacaaactaacaaacaaatattcatatgtactgtggtaaaatggtgaaggaaacacacaggaagtgatgagactgtatacatagggaaacataggtccgagaggcttcttggagaaggtgacattgaagcaaagacttgaaggatgatgggagcgtgccaggtaagaacacagcagcgtaataggtcagcacatgttaaaaaaaaaaaaaaaaaaaaaaaaaagctctgaagcagagaagaaggtggggctttaagaatccttagaaggccaatattgctgaaatctcagagaggaaggaggaagagtgggcacagataaggcctgacaggtaggcagggggaggcccactgcagagccctgcacatcgtgtgaaggattttgggtgttgggacttctagttaaacacagcagatggagcagactcatttgtctctctttatccctgaaactctaccaggttgatagaagaggaataaaaaatggcatttacccaaaagaaaattaacaaaacaggagaggagatgagaacagatcagagctccagtattttggtggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggcttaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccacctttatctccagaaggaacttcaacttcagcaaggtatgcagccattaaattgttcctcaattatcatccctatatatcatattcttcatgctgcagttacaactactccaaatcaaatcaatgcactttccttgcagtctccctcttgacaggcgacttacagtcacacaggccactctggctgctggaataaacaatactattctcctcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagccaaattcacagatttttttttttaatgttgtgccttagcttttttggattgcaaaaacatactcttcataatatggttgacattacctattttgaatttatcactctctcttacagttgaaaaatttgtggaaagcgtattttaatgatgaaaataaataacagtaaatttcctcatctgctttaacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctgaggctgaacgtcctttctctttcttcctgcctgagaagcagcagtcgtcttggaaccatcaggaccaaagtcactcgttaaaaatggtacagcagaataaaccatggcccaggtctctgatgacatcacggaactcttccatagctctcaactacctgcctccagacttcttgttctacaaaaaatatcaactcctctgtgtttaagatacaattggtcagatattttattaactgcaaccaaaagtcatctctaactgacatgttaattgaactgtaagcaacaaaatgcagaagactaaatagggagcatcgtccacccccgcaatcctccttgcggtggagaaatgacgtgagcactaaagagatcttgggtggcagagatctccatccttgctaccaggtggtgccactgatgcagaacagcttgacagctaatttaacgtttaaaacaattttataacagagggcttatatgggtaaggcactcttctagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgacagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatgaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagaggggaacaggtggtatgactcaaattgcccatgcatgcagaagcatgtgatagagaatgttttcttttcactgttatgtgttaacttttctggagactagatgctaatgatgagatcctgctgaagacactaatatgtaaatcattccttaaacaaaattacttagcagctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatgcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctgagttcctctgcccacctcatggatggccctgaagtcacaggagtgagtttgccttctttctcctctcagtggcaatgaccacggattccttgtcttttggattgcctcctacttcatagcagacagggctcattccccctttctctgcctctctgtttctctcacttctcacctcagctttcttttcaacacactggatctgacccagcttttattctcctcagaatcctggacaaaactacttgaggataaacctaaagcagcccttttttcctaagatgtaggtgactcttacttcagctctttttgtatgcaagtattccctgtagagccaaagagaaaaacggaagtgacaggccgatggcagaaggaatactaacattcgctgagcactcaagggcaaatgtcgtgtgtacctgataccatcgagtccttacaaggccctgagttctgtattatcagctttgttaaagataaaatgaggctcacaaatgtttggtaacttccctacggttgcatcccagagcctgcattcaagaccaaatctttctgacactcaaagcctctgatggccttccccgcttctccgctacagaacaaatgtctttccttacccagtgtaatcctaattagcacaagggtgaatgggcagtagtaccctcagaagaaccatgataccgggcaaggagcagagggtatggggtgaggcagaaacccttgcacaaggaccacagggagggaaactgaccagtcaatgggatgagggagtgaccaggaatgtaactagaccaataatgatgaagttcccagtcctccttatctagagaagtttgctgaataatcaacacctgcagtacgagtttctaccatttttcctacaaaagttttttgctcccatagaaacatacagctgctttctatttacatggtgcagtatatcaggcactctgagggttaactaagattctgtgacttagggacctaaccaccatttataacacatttcattccaaattgtatgcaactgacttacaaataaacttggaacagagcccgagggtaagtttggaaaggcctaaatcttgtctcaaggtgggaatgtggttcttgcctgactgctgagaaatttaatggttactgggcaaccaggaattaaataatttgggaaattttaactctacctttttcttatgagtattctttaggggaatatatatactttttattaagaaaatgaaatacatggtgccttagaaatagaatctctaatttaaaattttcattttccaaatgagagaactaaggactagaaagctcttagtaacttgttctgaattccctagtcagctaggagaaaaacatcaactagaatccaagtctttttctccccaagtgtgtatcccttccctgagcaagccacagaacaaaaatataaaggctcattctaagtgggacttcaagtctactcattcagcttaagggctcccaattgctcccaattcgaacagagggcccgtgaatttctttaaccttgacaaacatctgactggaaaacaaattttcccaaaagcaagcagggtctaattttcccctgttaagagtggtttctagaccttggcatcttcttaaatttttaagattcagctcctcctaacccgctctgacatataaagtcatagtgttgtgaagcagactgtgttatagaaggaagtcaggaagtaaggatgtgaacatttcttttaaagagtagcagcagcctccatcctgaatgaagaagccaggtctcagacactcccttagacgtgccgcctttaagaaaggacatcctctctgtacttctgatgatcagcttaatttcccatttgaataatgatttttttgtttgcttctgaagtcatgagaagcagttagcatttatgaagctttgaatggttgtccaatttgacttaaaggccacgagatgctgatgttaaacttcgtacatttatttctgggttcctgtcttattaaaacactgacataactctccatagtgcaagttttcattcaccatctgtcagtctattgcgctacaggaaaaaaaaaactccaggttaattatgtaaaaggtaatagcatcaaagaacagaacattgtgcctattatactctcaatgtgcaaaaatgggcatatttttatgtgtatgtttgtatatgcaaaaatatttacagaagcaaacataaaaactatactgttaattgtctctaggaagtaaaattaggggattgataccaagagtggttggagacttacttttcaatactatcctcttacaatgtttgatttcttaaagtcatgtgcactttttttaatgattgagtattaaatctatctatcttcttttcaagatttctctatctgggatttcttccaaattcttagcttcacccgctgtccttcaggagagtactattgtacaatggaaaaactactgggtagagaagaaaacttaatgggctctatttatgtctttgctgtaaaataatagtaataatggttatcatttattaggtgcttaccctatgtttgcaataaataacataaattctcaggttatcatttattaggtgcttaccctatgtttgcaataaataacataaattctcatataattaccttcaactgtgatatcattatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgcccctgtacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggcagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggctcattcttgtaatcccagcactttaggaagccgagatgggcagatggcttgagctcaagagttgagaacagcctggataacatggcaaaaccctgtctctaccaaaaatacaaaaattagccaggtatggcggtgtgtgcctgtagtcccagctgcctggggggctgaggcaggagaatcacttgagcccaggaggttgtggcaccagtgagccatgttcgcaccactgcaccccagcctgggcgacaaagtgagaccctgtctcaaaaagcaaaaaaaaaaaaaaaaaaaaaaaaaaaaatctggagtagattctcagagaacaatgtcttcactgactcgcaaacaagccagtctttcatacctttgtttatgctgctacactatctggaatatcttggccctacattttactttacctgagtattacaaaatttcttcctagaacaatgtttttttccactctccaaacaactctccctaattattctaattaatactgctcttcctacctatataaggtaccatacgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatgggggaaaaaaatcaatgcctcacagaaaactgtaaatgtaaactgaccatatctatggtatacatgagtcttcctcacccaagaggcaggaagcaatcttccttttctgttaataactgaatagccttttattaggacagccactgtaatttagggctctgcatatatttaaaaaatgtgaagaaacaggagttggtatagagaataaaatttaatttaatgggtagataatagatccactaaggatggataaagggataaggcttatttagctgaaaaaaaattaaactgtacagtatttatgtaaccaggaggctgttaccaactagagcccctcaacataacacacaaaaaagtgtgtattatatcagaaaagtttggaagagttgtgtttggttaacttcgttttgttttcacattactcaaaaaagaagaaaaacacccagcagatatttaaaagaaaacatttgtggtcactagaaataaaaaatacacaaatattaacaatgagatggtttaattttccttgttacaatagcaaaagtaaaaataatactccatgctgggaaggacatggttagattggcactttgaagtattatgagtgtaaatggctacagccttttgagaaagtttcaggcagtgcattccaagaagcttagaaacattaacaccatttgactcagtgattccacttacatgaatcaaatgtagaaaggtgttatgcataaaggtgttcctcaaagtcttacgtggaacagtagaaaaattggaaacgactatggaaataattatcagctctatattctttaattgcgtcttggccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagtaagatcataaaaacttctataccctcagtaaacgtttttctccttgatatttttagcctgttgccctaaagtttgaaaatacatggcacgctcttaaatgtttactgaagcaggaaaccaatgaacgaacgaggccatcagcacatcaaattgtgttcagtgtttcctttctttgtcatataaattctgaatccatagtgacactttttacgggtcttatttctccttatcaattaattattccttttagggcaaaattaattccagaatagcagttcacttggttttgctaagataacaaattgccaataaaatctacaacttaactgatattccctattttaattactttgaggctttatcttctactttctggaaagaactccatctctccagagttccatcttgccagtttaataatccgccttagaaaaccctcatctgtatctttccatcttcttgagtggtatttgttttcctcccgagcaaaatcactctcccttgctctactgtgcttcattcaatgaacaattattttttcagaggctaccatgcaccaggcactggtgacaaagatgaggaagacagttcctgctttaaagaggctcattacaggctcatctcattaaattgcactttgctgtattgcactttgtgaaaattgcattgtttacaaactgaaggtttgtggcaatcctgtgttgagcatgtctatggacatttttccagcagcatgtgctcactttgggtctgtgtctcgttttgaaaattccctcaatatttcaaatttgtcattatttttatatctattatggtgaatcgtgatcagtaatcgttgatgttactactgaaattgttttggggtgcaactaaccacacccacataagatggcaaacttaattgatcaacgtcatacgtgttctgactgctccaccgaccagctgttcccccatctctttccctctcctctggccttcctgttctgagacacaacaatattaaaatcagggtaattaataaccctacaatggcctctaagtgttcaagggaagaaagagccatacctctgtcactttacatcagaagctattaatgattgagcttagtgaggaaagcatgttgaaagatgagacagactgaaagctaggcctctcatgccaaacagtcaagttgtgaatgcaaaggaaaagttaatgaaggaaattaaaagtactaccctgcgagcacacaaatgataagaaagtaaaacagccttattcctgatatggagaaagtttgagtgctctgaatagaagatcaaactagccacaacatttctttaagccaaagcctaatccagagcaaaaccttaactcccttcaattctatgaaggctaaaagagatgaggaagctgcagaagaaaagttggaagctagtagaggttgcttcaagaagcttaaggaaacaagccatatccataacattaaggtgcaagatgaagcagcaagcattgatgcagaagctgcagccaagttttccagatgaagctaaggtcatggatgaaggtggctacaacgaacaacagattttcaacatagatgaaacagccttctatttaaaggtgatactatctaggactttcatagctctagaggagaaatcaatgactgccttcaaagcttcaatggacaggctgtatctcttagtagggcctaatgcagctggtgactaagttgaagccaatgctcatctaccattctgaaatcacagggcccttaagaattatgtgaaatcaggccgggcacagtggctcatgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactttgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttgacatagacagtgattcctctgatggatctgggcaaagtaaatggaaaatctctggaagtcaggtgtggtggctcacggctgtaatcccagcactttgggaggccgaggcaggtggatcatgaggtcaggagtttgagaccagcctggccaaaatggtgaaaccccgtctctactaaaaatacaaaaattagccgggcgtagtggcacacgcctgtagtcccagctactcgggaagctgaggcagaagaatcacttgaacccaggaaggcagaggttgcagtgagcctagatcacgccactgcactccagcctggacaacatagcaagactgtgtctcaaaaaaaaaaaaaaaaaaaatctctggaagtgattcttgatgccattaagaacatttgtgattgataggaggtcgtcaaaatatcaacattaccaggagtttggaagacgttgattccaaccctcatggatgactgtcaggggttcaagacttcagtggaggatgtaactgcagatgtagtggaaacaggaagaaaattgaaatcacaagtggggcgtgaagatatggctgaattgctgcaatttcatgatcaaactttaatggatagggagttgctacttatggatgagcaaagtaagtggtttcatgagatagtatcacattctacagagaaatctttcacaaaaggaagagtcaactgagtggcagtcttcattgttgtcttattttaagaaattgccacagccaccccaaccttcagcaaccaccatgctgtgcagccatcaacatcgaggcaagaccctccaccagcaaaaggatcattactggctgaaggctcaggtgatcgttagcttttttaacaataaagtattttaaattaaggtatgtacattgttttttaagacataatgctgttgcacacttactagactacattatagagtaaacataacttatatgtactagaaaaccaaaacacttgtgtgacttactttattgtgatatttgctttactgaagtgttctggaactgaacctgcaaaatctccaaggtatgtctgtatttagtcttgagagtcatgagcataaacacctgtaaacgtcgcaagtactttcatcaaatgcatggaagcttatccttagtgtttggacttctctgcagataatttgttttaattgctacctcctctcctttaagatcagtttcctttgaacccaggatgtccttctggtatcttatctatgtcacctcaaactcctatgaaagctttttagtttttttatgtttcttgttcccgaaatatctgcatagagggttggttgccttactgtccatgggatctcctgtacttcaatcatttgcttgttggtttttgatactttctctgccttttctctgctctgctgtttattacagtacattttcctgctcccttaccaattggcttccaagtaagtttggccaataggagtcactggcagaagcctagagggcaggcggaaaggagaagccgggcgtacttcctttttcattctacctccggcaataggtctggctaactgtgtctccttcctggctccagctccctcggagcccctccctcattggtcccagctggccaaaggttccaactccgccttgatgcccatgacatctggggctctggtgataccacctcttgtcattgtccctccagccctaggtataacagaaacttcatgctgtgtgtgtggcttctcagcacttccattcttgagtaaccaatttcccgcattaaattccctttgtttgaaataactagagggtttatgttttctgaccaggcagaccctgattgatacatcttccaaatcaaaaaccttagtataaaaaaccttcaacataccatataaggcttttcacagttttagccctcctcatctctacagccattctgtgatacctccactaccacagactagtaccaccatcatttattagatatttatgctcttttttgagacagagtctcactctgttgcccaggctgaagtgcagtggtgcgatcttggctcactgcaacccgtgcctcccaggttcaagcaattctcctgcctcagcttcccgagtatctggtactacaggcagacgccaccacttctggcttttttaaatttttattttagtagagatggggtttcaccgtgttgcccaggctggtctcgaactcctgacctcaggtgatccacctgcctcggcctcccaaagtgtagtcttttttatcctgaatgatatattattttagaattgggggagggcaaacaacacagtacaaaatgtattattttaatttgcatgtcaaattaaagtacgtgtatgctttccaaaagttaggataaattgtgatcaggtgatctttatcaccttggttaagaagtaaaatacttcagaaaaatttagtggctccttgagtgtcaaatgtgaagacctaaacctaggtgtctctcactatctgaattcttggtatctcaattcaggaacccaatagattattaaataaggagagacactggtatatgataataataactaataataataatgcatatcactaatagcaattataattccttgagcagttactacatcagacattctgttaccttacatatgtcattctaatcctcacaacacaagataagtctcatcataactatttaatacatcacataactgaggtttaaaattattagtggcttcctttttgaccacagagaactggtgacagaatcagaatttaaatccagcctcaaagtcaatgaacaattttgttgctgcaaaacattgcctccaaacctaaactcataaagtgacaataggaaagtcacagtataatcaattagttcccccactgaatgcaccccataaagagtgcatatatcacagtttatattctagataaaagcaaacctgtattttaaacttatcacattatatacattatatttaattatagggggtgcgagagacattaaactaggcagcagtggctctgccgcttaatctctggttccttcctgtaacacaatgatttctatgctttgtcttctaaaacaattgctaaggagagctaccaagtgggaaagaaaatagatccctcctctgcctgaacttgactcaactggcaaaacattaaaccgcataaataacattttcaggtgttcctgtttggttaattatcctcccccgacctgagtcacttgatttgagtttacatttatactttcaaaaattaagtgctctagaacagtgctactcaaaatatggtctttcacaagcatagatatggacagtgtgttaagtaacttctatagcaatttgacattgccatgacatccaaattcatgatcaatgaattcatctcatggagcagggtacagacgaggtcaagtgttgttgaacttgactgttgagttacatgtggtgtgaatgcatacttgtcagtttcattagcaccacctaaaaatctgtgatgtgtagtatgttaaaaaccaccaccgcggctgggtgcagtggttcacgcctgtaatcccagcagtttgggaggcggaggctggcagatcatgaggtcaagagatcgagaccatcctagccaacatggtgaaaccccgtctctactaaaaatgcaaaaattagctgggtgtggtggtgcacacctgtaatcccagctactcgggaggctgaggcaggaaaatcgcttgaacccgggaggcagagtttgcagtgagctaaaatcgcaccactgcactccagcctggcaacagagcaagactctgtctcaaaaaaacaaaaaaaaaaacccaccaccaacaaaaacctggcccttcaccagtttgagaagcactgctcttcagtgatagcttctttttttttttttctaagacaacgtcttgctatattgcccaggctggactcaaattcctgggctcaagggatccttctgcctcagcctctggaagcgctgggactacaggtgcgtgccaccatgcctggccttaaagtgatagcctctttacagaccaagaaagtaaaatataaaaacaatcactttcttaccaaaattaatgcttggtaaagaaatctgtatgtaaatatatcaatataagcaacatttgtctccgttatataagcttctatttatgagggggtgtaatgactttcctggagttatgcaagcgatgaacgctttgtggaatagcaaattttgaaacattcccacagaatatcaccaattcataaataagctaatgattcatccactatgtcataagagagactttcagaatatttttaggtcattttattactaccgtagagggtacagactttaaaaactatctattttatgtgagtgctctgactgttctgaatctctttccagcaaaattgcagctcccaagagacatacagaggtaatcagacttgtgggcttaaaaaagaaatattggaaatgtctgaataagagcagacacgtttttagatgcctttactctgtgtgcaaaaatcatcttctgcagatccagctacataaaattgtacatatccagcacttttcttctagctgcaggtgtaaccttaatgttcctcttatttagatcagtaaactacaatttggcagctcttttaaaactgtaaaccagtcaaagtctaaggaacaattctttttgagtttccttctgaaataagcttggagagatgcaattcagaaatatctattatgttcttcaattagaagctttaaatcaagttatttgaacaagaaaaaatattataatatttagaacagtccattaaaatgccataaattttgatttggaagttacatttctattttacaaatggggaaagtcaatggatcctaatcaaagttaaaagagcagattatttttcttttttcttttataagctgaatagtaaaggaagaacatttataacagccttaataacaaatttgagtaaatctcctgtgctaattttgtcagctagggaataaagaatgtcatatggattccagtttaattatgccgataaagcagttttataaatcatgctaagagtaatggatgttcctttgagaacagagaactcggagtttgtaaaatgtgtgttctggacttggttccttatcttctaccatagtgagtataaatcaaatcaagtcttgagtctcagtctgctcaagtccaaatggaaagaagggaaaagttgccccatccaccggtatggtagcattatttcccaaatcaaaaactggaaggacactcaaagggatgacaggacaaaaaatctgaaactgaaattgatagaaaatccaggtcatatgccacctactctatagctgtgtgaggattaaatatggttatttctgaaaactcttcgccattgtaaagtgctacacaaataaagtacaattattacaaatatgattataggctaggagcggtggctcacgcctgtaatctcagcactctgggaggccgaggcgggtggatcatgaggtcaagagatcgagaccatcctggccaacatggtgaaaccccgtctctactaaaaatacaaaaattagctgagcatggtggcgggaggctgctgaggcaggagaatcgcttgaacgcgggcggtggaggttgcagtgagatgagatcgtgcaactgcactccagcctggcgacagagtgagactccgtctcaaaaaaaaaaaattaaattaataaatatgattatcctattattcatatcctttaggttggtggtgacaaagaggaactgggggtttagggctgacaacattcatacaaccaagctttactctagccaggggttaaaacaaaaccagtcatttaatgatgaaagatcactggccaacatgacatataagaaaatgaagaccaatagaaagcaagggacttgcccgaggtcacaccaaagctggcatctgaatctagctatcctttccagttcaaagcgttatggcagtaaaaagtcaaaaggcagaggttttaacactgagcaatatattaaggaactagaagcaagagccaaggaaagctaaatattgagtagcttagtggagaacagtttagttcacaaaatatgctgagaaaagcattaggacaagctcctaatgcaaaaggaaggaattcatagtcattcagaatcctgcagtttctaacccaagagcatcctcaggagggaatacttaatggaatgtagaaagcctatcaaaagaggagagtgaacaaataactacaatatcccttcctcttgggcaagctgaggaaagaggtacaaggattttgatagcagtgtttttaactctcttgcaaattgctgatttataatgatattgatgtatctttaaaaagcttttagccccattgacttaactaggacttaactagttctcctaactagaactgctgaagaatcacacccctaacctcaggcccagcagaccctaaaattaaaccctcattttaacattctgaagctctctgcaaaccatagacatgaagctaagggctacgtgctgatagactgccttcaaatcttatggtttttaaagaccacttttcctaagaattccaaaaacactcagaagtccatttttgaaaattgagagctttcgcatcattcaggtgagcatcatgctggatagtaggatccaaaaattgggcaacagattaaaaagggctagatccttctgaagaacgctataacttaagaaaaggaaaaccagtaccccttgagaaaacacttgtggttaagagggcttcaatgaaggaaaaggaaattggaataagtaacaccagaacatacggtgcatctagattttaataaactgcttgaaataaaatcagctttctgaagtgcagcgattctctcttcacattatcctatttttacctacatgtctccttcataaactggtcttcttgtactatactgacagtatcacaaatgcaaaaaaactcacattgtaatttaaaaaggaaccattggggaaccacatattttattgtatttataattaagagacccccccccaataagacaggctaagaaataatgtttttaaacagggtctcgttctgttgcccaggctggagtgcagtgatgtaacctcggctcactgcagtctcgtcctcccgggctcaagcgaccctcccacctcagcctcctgagtatctgggactacaggcacatgccaccatgctcggctaatttttgtattttttgtagagatggggagacggggtttcaccacgttgcccaggctggtcttgaactcctgagctcaagtgagctgctcgcctcggcctccaaaagtgctaggattacaaatgtgagccactgtgcccagcctaaattctactctgttggtcagtatatctgtccatatgtaaatactcttgattacttaaatttgtagtaagatttgacattggaaattgtgaaggccaggtgcagtggctcacccttgggatctcagagctgtgggaggccaaggtgggaggatcgcttgagcccaagagtttgagaccaggctgggcaacatggtaagacctccatctctacaaaaaatttaaaaaaagattagccagacacggtggcacacggctatagtcccagctacttggaaggctgaggtgggagggtcacttgagcctgggtgttcaaagctgcagtgagccatgatcaggccactgcactccagtctatgtgacagagcaagatgctgtcaaaaaaaaaaaaaaaaaccccaataaaagtatctctaagcagcatatattatgtgtgtgggggcagggtgagctttttaaaaaatattttcttaaaatttcagtaatgaacttagggacctagacataaattgtgagaaaaggacaggcttttaaccacataattgcacttcatgtaaatcaatattatattagtatttcaaaataaattccagagcatattactatctaacatctactgatgttgtaaatgctttctggagccttgaagagctcagagttttaaatcaccaagctaacctattggaacagtctttccattacatttgtaaaaatgctaatagaaatctaaaactcacctcatgaatcaaacatattattacttctagggagtgacgaagaatgtaccctctcaataacaaatgaatgacccagaggagtctaatgggaaatatctcaagagcctctctatttgacaacagcttgcctcactcagcctgtaagacacggatgggtggcataatcttctcctgttgtttgttttctcagaatgtacattttaaaacataggaatgattacatttttagaaatccacttgtctgcagagttagccgaaaggtacctcttgaaaaataatgatcacagcaagtttagaaacagcctgccccaccctcagcccaaagtaaaagaaaaacaaaaatcttagacacttgtccaatatcgttactttttttttttttttttttttttgagatggagtttcactcttgttgcccaggagggagtgctacagcgtgatctcagctcattgcaacctccgactcctgggttcaagtgattcttcagcctcggcctcttgagtagctgggattacaggcatgtgccaccacacctggctaattttttgtttttttagtaaagatggggtttcaccatgttagccaggaaggtcttgatctcctgactcaggtgatccgcccacctcgacctcccaaagtgctgggattacaggcgtgagccaccgtgcccagccccaatatcctcacattttaaagataaagcaccaaggtctacaaaaaatagacatgagacacttggtctcttatatcccacttactccactactattctctactaccattctatgactattgggggtagtcacagacaaatgctgaaagaaaactgatttccagttgcttttagtgatttattccctgtgaaaatccaagacaatgcttttgtcaaaccattaatgtgatgtaaaaaattttctggggactcaaattcctaatgactgttcagtcatcatagtgaacctttaaattatttctttactatgtcttgctttgtttgtgtaggactctggcaatattttctctcaattttttgtgtaggtacacagccgataaatgagggaaacacaatatttctaacacttgatggaaacctcctctgcaaagccattttagatctgttggaaataatctaaaattaattatcttatattgttttttatctattttttaatcaaaaaagttctattttctctaccactaaaatgtctacatctgcatttttcacaactggacatacagactaaaaatacatgagatgatctctttgagtttaaagttacctgacaaagtccatgagaatcagggtccttaagtataaattatctacatatatgtggggcgtgtgtgtgtgtgtgtgtgtgtgtgtgtgtggctactgctgcttttctgtcataagttctcattagttaatgaattgtagctatagagacactaagtaagaaatggaatgggggtatcgacgaagaaacttttttaccaaacatctaactgtaaataatataaattcattgtagaaaatcagtggaaaaggaatgaaaaagaaaaccacccagaatgtattagagagctccaatggtaatatctcaagcaatattatagcttttcatcagtaaatacttgctactttttcagttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctgaaacactgtaattttggagagggggaaaggcagtgctggtagttaatcttatatgggatctcaaggatgtaggcaggctgggcgctgtggcttacgcttgtaatcctaacaatttgggaggccaaggtgggaggatcacctgaggtcaggagttcgagaccagcctagccaacatggcaaaaccccgtccctagtaaaaatacaaaaattagctgggtatggtggcgggtgcctagtaatcccagctactcgggaggctgaagcaggagaatcacttcatcctggggaggcggaggttgccgtgagccaagatcgtgccactgcattccagcctgggtgacagagtgagaatctgtctcaaaaaacaaacaaacaaaaaaggatgtagccatataacaatcattctatatgtgccaggcaacagtgaaaggagtgcccattgtttaggacccaccataccatttccagaaataccactcaagtaacttactattcataggtaaaactatcaattcctatatacgtgtagcaggtatgtagtaaccaacataaatatactttacctagtaaataaaatcaatgagaacagtgaaagtactaacagaaaactgaggacaaatccaggtgtagccccacatagctgtgtagccctgatcaattcctccctgagcctggcttcgctgtcctgtgaaatgtggatgttgataccatccaccatgcaggttggttgctggcacatcccatgtggaaaacatacaataggcccgcaataaatgggagatgttatctgatgaatcaccacttggataaaagcccaacgaatgtttgattgttacaaaactattggaaatattaactctgaaaggtgaaaagcaaacttcaacacttagttcacttgcaagtggtttgttattgggctagcaagaaacagaatttcaaagggggctggaattgatcacacacttacgatgacttccttttattatataaaaattatacctgaaagttgatttcataaaagagaaagtttgcaataaatgagttctaaaatcccctgcaactgtaaaattctgttataattcaaaattgagtgatgtcacaagcccaatgtcacaagtcatgagagattatcagttttgagtttatcaccacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaagcaagttataagacagaatgattcaacttctataaaaatatatgtatagaaagacatttttgaagatcctagactattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggggtcctgggagtactgggatagaaagaccagcttgcccaggacagctgctgcccacttcagatgaagccttttcattctctcatttgccaaaagataagcattcacgttttccacctgtggtataaacagtccacaattataagccaaaaacattctgtaggggctggaaatgtagcacttgaaaattagctgatcccaattttatttaaaattttaaacgtttacacacttataaccagactgaaatgacataatattactcgaaatgtattggatctctctggctagtataagtgactttgtttttcctttttcatgttttttatttacatttttcaggttttctagaagacatttaatcatttataattagaaaaatgtttaataaaaccattttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacagtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataaccgcaccactgcactccagcctgggagacagagcaagaccctgtcccaaaacaaaacccaaaacaagctgcaacttaagataactcatttcagaatattccttgtagatctaaaacgacaaaccagacatctggacatttgtccagtgtaaaaagactggtgttttcaaacccttatttgtatgctctgtacccattcaaaataattcaagttatgaggggaaagaaaacagaactgtcaggctcttacataaacacaaaacaagccatactaaagaaatcatttaaatgttcacattaatgacccgccaggccttaggaattgtgagcaccggaaagacggcagaaaattcctttacacaacatttgtggtttggcaaaagggttgtcttggtttcacacggaagaaatcaacaagcacctgaaacagttttctatcttcgtgggaagaaaaaaaaaaatagccataaattgcaactgtttttccatcattttaggcaccaaagagaactacaaagacctataggccctctcaggtatattgaatttttaggaatcaatcaacttctaaaacttgtttttaaggaacctctgataaaaagaaagctgactgtcaattttggataggaaggtgccactgctttcacccttgaaacaatctagtgatgtatttatatagcaagtaactttcacactgcaaactactttatcctaaaggtcacctgtcatttaacttggaggaaacatggccatgtccttacctaaagactggtagagctctgtcattttgggatggtcccagcaagttgtttgagtctcgtggctaaaacacaaaacataaagaaagactttagcatttacaatgagtagtcaagaaaacaggaaaaaagaaaacaacaataacaacaacatgatttttgcttttgaaccattcggaatctttatttcaaagcgcttccatagtgtattgaagaaatgtttatcttacaagcagaaaggcccctttctgctttgtttccaaagagaaaagcaatataaacattattcggttccagaatttgtttcttctttgcacccacaaatcgatcgcacttcagttatgataaattgaccttgttatgtgatcaataatcgactatcaggacttcttcacccatccaatgtggaacactacagaaaggacaccgacaactgattattattcaactctgtcaaagagataccggacattagttcaataaatataaatcatctcacttctcatttgctttcactgcccctgacatttttccattactctttcctctacatatacagatctcatatccatgatacctgtatttcatttcagcttaaggtatatctactgcctgactaatatatcataacttccttcttcccattatttcagagtgttttttctttaaacgcagtacgctatacaccactacacctcttcctatatttacttgggcctgaatgaagcattcacagctgtcttccatttcttgaagtgtggttgctggctatcagctcctgccacaaaaagaacaaaacacctttgttcctcattcaattacatgaataaaccctggagaaataactacatatacttttccttactttggcccatctacataaatcaccatagcgtcatatttccagttttcagggattgcatgacaggctttgatacagtaaaatgcagttctgaatgatatttgggtactcatatgcagagcctattcataaacttttgaggggaaggggagggaaggaaaaaagagaaatcgcttaaactggggcatttccagaggaccagaaagtacaggggcctcacacagaaagaggagtctggagaggcaacaatgtcgaatggccttagcgtatgttttgaattttagggctctgcgccctactggcggtgaaatttaaagcaagcctgcctaccttggagggttaaaggattagttgaaataggtaagtgaccggcaccatttggtgctcaatatgtggtcgcttttggtatcatgtgcccctcaaattgtcatctattaaaagcaaatctgttattagttgattacaatatagatgtggatccaactgtaattaagtcaatcaaggcgaagaaagacccttcctagagagcaaaaccaacacactacatgttatcacctatgtttaaaaaaaataagttaaaacaaccgtttaagttggtttaagaaatggaacacaatcataaacctcataaagacatatggaaatcatccaaactgtacaacttcaaagaccatccctgtaatatttactagtcagtgattgaacagtgagggctactgaaatcaatttgcaagaaaatgttcacttgtgaagtgctgtttcactgtcttccaaatacgtttatttcagttttacttttccatagagacaactcacatttgaggactataacaagggcttatcagttgagggaatataacagagtgacattcaagtcttaaagagcaagaagagcaggagatatggtctctatgctttaaggggttttaggacaccccatgaccaagccggtttatgatctggagaaggggtaggcaggactggtactttacatgcacagcacaaggaggctgcagcttgcagcttcgtggaaaaagtgttgcttgttctcaggcatttctcagctcggaaagtgagtgtataccaattccatatataagtgcagagcaaggaaaggttaccttctattgagaccaccctgcattcaggcctcctctatttccaaaggtcatccagatgtgatataagcaccagggagaaaggaagagcgaagagaggaagcacacacatgtgtgcccacatgtacaagggctcacacaggcccttactagtcacactgtgtaacaacaatgtcccatctccaggatatttgtaaggaccgtagcatcttctataggtctgcagaaaaacatttagctgagctgataagcctgatcagacagagacagggaaccacggtgaaaagccaccatctggaatggacttcaaattagaggaacataggcaagaaataaacctgtaccaaacacagttctaaaaggaaagggaaacagtgtgtacaatttacaggagaatcccacatagaatgaatgagggcttcatggagctccccatcttctaaagaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttctcaccttcaacacacaaaccttttatttctaagcaatgcaaaagaactagaaaaacagatttagatttcacctttgcagtcttagtttcacttcaattgcaaatcagttctaagcaaaagaagtgagcacaagtggaaagaagaaaagaataaagggtgtgactaattcttaaaacgagaaaaatagtcttttaatcatttaatgctaaaaatgcttggcaacgtagccaaaaaaccttcagattctttggtaactatatgacgaaccaaatattcacttcacggcttgttattttctacctgtgatgaatccagagccccactgggacacatttaaccctccaaaatagataggaactatgaatatggactggatgaaactgtaagcacaaatctgcataactcatatctatcttgtaccttgaaggacaaaccacatttttgtctgtgatcaataccgattttacagcttcgtttcttactctgtgcctgccttctaaaacagtagagaattctcagtaactccatgagaagagcccacatttacctggaatatgcagacgatatagaaaaacacggtgtgctagggaggagggagtggaagggtgggtggcactgttttggtaattgtctcttttctgcatttcactctccacatcggaaatacactccccatataccatgaacaaccaaaagggaaattctgaaacctgttcacatgttaatgggtacatctttgtttggcctttctgagaacaacaatgttcaacatagatcacaagtctgtacgtacattaacacagagatcagcttcataaataatccttaaaacgctctttacatctttaaaaaatgttattgattttggccctgctggttccaaagcctggcatcagatatgcctctctgagcagtatttatacgaagatttcccctctccttcttctttctacaaaccatgataatctttttcccttttatttgaggcggtgataggaccctgatgcaaattaaaatataaagtcatcgactatgacaaaagaccccagcaacacctacttgtcaataataagaaattaaagcattactctactgagcacaaggctgacctaatttcctaccatacaatttaaattttctctcacctgctttagtttcaagtagtgtgcaaggttattataactgcctcagagctgttcctgctgtcagtgctggaataatcagacttattggaattgcttttttagtttcttaaaaacaaacattaaacacttataaaaagtaacaaatatctactgctgtggctgggaaaatggcagttgcctaattaaaataagatttcttctgccaccattgttatttggtactgaaaatattccaaacagttgcctttttaaaaaactatctgtccactacttcccagggagaaaactaatcgctatgcagcaatataaaaagggagcgttctcttgcgatttgcagaggattagagtttggtttcatatataatctggagcccattgatccacacacacaaatgatttccctttaatctgaggatcagactctttttctagaggaaccttggcatttgcgtgctgaattgttgaacttggcttgcattgctggaatactggcagggtgtggatggtaaaatatattttaaagtttctgctaccgtggggcaggggtttggaggggtgggcatcaatataagcatcagaaatccattctagttccccatttcttgttccctgggatatttaccattttattctgtctggctaaagccagggcaaagatgattgcctcggtggctgttccagctgttagttgtcctccgttttatttgcttttcaaggtttaactcctacccaccctcaactttggtcaaagcaatttcttttcagggtcgtgtccaatcggagatcaaacaatgatgactgaaaccaattccacggtgttcaagggtcagagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccccgaaagtggagcgccgccgccgccgccgcccaagctcacagctgaaagcactgcggaggagccggcgcgggcgggccggggagggggcgctgcgggcagacggggcggggccgtgtcgggctccgcccccacctagggacctgggaacccggacacccagagactgggcagttggggctttcaaaacggaaaggaaaaagaaaagagaaagaaagaaagaaagaaagaaagaaagaggatggggatttaaggtagacccaggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatagcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagtttgcagtatgatgatagaagttaactacacacaattatttcaagcttggaaatactcaaaagaagaagaaagccttcattagcacaagaattttctgcaaacttcacataacaccttagattagcatccaaagagcatcttacgataaactgttagtgatattttcactgcccttctttgtccatttattttgttggcttgcttttctttttattttctttcaaacatttgctttccactctcctttccgattgattcattccacttcggtctacagtttaaatgtggtcccctttttaaaatttatttcttaagggatgggggtctcactgtgttgcccaggctggtctcccaactcctgggctcaagcaatcctcccacttcagcctccaagtgcctgcgatgacaggtgcatgccaccatatccggcttcttttgaaataatccttttctgctcaacatttttccccctagaatgttttaggtggaagcacacccgttttgctttatctaatgctatagcatggcaaaagaggcaaaaataaagtatctggacaaaagcaaaagggaatgccaggattctttattacctttaacaaaccaaatataaaggtaaatgttatcactaaagatatgtgcatgtaagtatgatcggtattgctatttttaagcaaatatggcacttcttctggcattctggctcatacactgagattacttagtgttgccctttagcaattttaagctagtgagttgtggaggcagctgctattacggtctgaggggggcacactaagatttgctttggctgaagttgtcccttggtctaatagtatattctaggtctgctccgatccttggggaagagggattagtgtcctgtaatgaggaagtagtgccctttgcagtaaatcagagacaccaatctctgtgtcagtgtggcaaatcacttaactactgtttatgtttatttcaacgaaaagacagaagcctcagagcatggacatttgtaaatattacaaatcgataaactaaggatttgtaacacctggatagtaagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgcttagctattctgctatgctgccatgaagagacatggcttcttttcctgtgagaaaggtctgtgttttttctagtatactcatagacaatctcactgatggctcagagcagagaagagtaaatttgctagaaatagagataaagaagaaatgaaatgggatgaggtcaaagaaggcgacccagtacattttcccgtagccaaaactctggtctttgaaccacttaaactttgagggtatctttagagaataagggcatctctgacctaagggactgtgcaggatgcttccccattctcccatccatctctattctttgtccttctccattctgctctgtggcccaggaggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagctatggatttgcagtgtactgttggaagggtcttgggttcgaatgagcccatctagtggaggctgtgaagggccaacagctgaaactaggctgttcctaccttccacaaacacatctttttcctttctgggttgcatgtggtttcaatgttggcctgatgctagctgtgtaaaaatgcagagtggcataggaaaggacaaagacaaggaatggtttgaactgggtacttgcctggagggatggtcccgagagacttcaccaactcctagggttcagcttctctctatctatagtgcgccctaagttttagtataacctgcatcactttataaaaattcatttagagtataggtatcacttcaattaactcgaatacatattctatagtaaaatgtcagcatttgggtatacaataaagacataagaattccatattcctctttgcatagtacaagtactaaccatgaacagtgactcagacatctaacaaatgggttggtgtatggtgaatcattgctggttagggcaaatattatagcatactaattgaaatatatatataacaatccccctagatcaatctgaaaccaacatcttctggatgtaagaatatccagccaggtcacattaaccagcaaatgaagaggcctctaagttcagacacagagcacttcacacccacacaaaagcctatttttccaggccctgtctctttagggaggcagagtaagccagactcaggaaagttctctgtgagccagctgccatctaaaccagagatttcaccagacaggttccagataaagtcgagctctgcttcactctcacacagttttcttttaataagatttctcaaagcttcacagagccacctatatcaagccgaacatctaaaaagatgtgaattttagcatcttcactaaaataaagccatacttcattaacctcacaggccgacggttgcttcatgggaaagaatttggagtacctattagcctgccagctatagcgataacccatgtatatgacccacaccacctcctgctaaaaatggatcactggttaatgtggttcaagtatatctgactacagcattcctggtctaccttaacagctcaaacttgtaactatttgtctgcctttccccaccgattgtgccaaataagcggaatttcaaaactgggcagaaattcttacactctgcataatctctcttcctcttcagctacaaataaggctttgtattcgattagactcacagcaggtgaaaaccccaattagtgaattcattctgaggcctctaccttcctcccacacaacacatttttgtaaaaaaatcagggaagtctgcgtctcttctcaaatcagaagtaaattaaccctttgatctacccaagcaaactatttactgcatgaagacttttcactgcaaaatgggaggatgttgaaagattcctccttcttgactccataagggaggttacagaaaattctattttatcagactttattgttttcttcaaatccataaatactcacattttctgatcaatctagaaattacagtttttctttctacctgacactcacaatgctaatattatctaacaaaagattaatggacagtctactacaagagagaattaatttttagttatgttcttattttggtgtatttgaggtgagaaaaaaaattaaattttagtttaaacagtatgctttggccttaggaaaggcacagagtctatatttcatactttgtaaatatttatttgtcaaagaaaattcatcattggacaaggatagatgtttggttgaacattaaaaaaaatcaacgcagctttagttcttagagtgatttactcatactttgtcaattgcttctctggaaacaattcacaacctagttttatttatgaacatatgattaaaaaacagcagctttgtcttttttaattgttttagtcctgtcacttttcttgaaacaagtcgtaggacttacccacaagaaaatactgagcatatatcaagtagtaatgcagcttttagaagtagtcatctgttactgtcagaggttcatttcattttgagtctttttaattaaaatgcaaagttctacatacatgcctgcctaaattacccctttctgaaatactcaaatttcaaaaaaaaattttaaatgctaatgtaaccattgttaatactctagacttgcttcttgagatttggaaaaaagtaaacaaaggaattaccagtcaattaagcgaacaaggaagtcatcctaagttgaaacagataaggaaaatgtaataatcaaatgctacagatgaagacaccagcgtttttctttttttttttcctgagatgaatatctacaagaatcacgctttatcaaaagcagcttccttaatcttcagcaagcgtagctgtgtattatagcaaaggcatgaagatagaggggcagagtgtccagaccaattctaccccttagaggtgggtcacttaaccctttacaggcaagtcacttaaccacttggaagcttttgttaactcatctatagaatgtggataatactgccatattgtgggtcaaaatgacacaacggctctgacagcaatttgaaggctggggaatgctgtgttcatgcaaagcagcctgtcaggcaggtatgatttcttaaaagagaactcagtatgttcaggaatagttaggtatacagaaccaaataaattcactttaacattctgttttagattgtcgtgtgagggaaaatgagaggtctgagtttagtaaactgctcttctgtaaactgctctttagcagtttacaaaaggcacctttcctctttttgctttttacacttaagaaggaagcaagtaggaaaagtaagattttttttgtgtgtgtgcaagataaggcactagctgtagcctgagataggcataaaattcacagcgtttgctatcattcagtggggccgagattaaaatatgaatagtattcacgcatgttaaaaggtatatccatgttcatattctcagacagcagaaacctggagtagtcagagagcaagtgaatattgatttggtgggggacagtgagggagaaatatcccctagcttgatggagaaagtctcctggtggcaagccttgaacagccagcaagtggcaggaattccacacaaagacagggatccataaaaggggaaataagataaaatccagtttaaccaattaatgatctaccaatgtctgaatcttgtactccagctctggcttacttttgtcaaggcatgttttcaagatgaaaggaaaatacagatgcaaggaacttttatttatccacaaatttccaagaatgttttttatgtgctctatctagactaagtttctctattaaatattatcctatattaagttctttaaataacttcaaacatagtgtatttatggaacacttacatatgtatttgcttatcatttaaactcttctcattttttctttatggttggtaaaaactggggagtgtttggagaatgacatggaaatatataaaaatttcaacattgtaatccagtttttttttaagtgggatcccaaggaaatatggccttttccttaaggagcttatgatctaatgagagaagatagacccatatatagctaaacacagtatcagacagattataataattacagaaatagagagaaaaaaagcagcaaaaagggaaaggtgattagtttggcctcttgggattagagaatatgcacttcaattaaaaactaagtaggctttaatcacctagttagttcttaaatcaggttttgtgtgtgtgtgtgtgtgtgtgtgtgtgtgtgtgtgtgtgtgttctttttgctagaatatgaagagttgaaacaagtttcttacattgactctgtgagctaatcgctcatattaataatttactaaggtacagagtttttatgttaatatacagctgtgttacgacatcagtttaggctttttaggaattcaaaaatgtatttggccaatattggatttgatatcttgggaaggctaactggcagaaaatactactttccccattaggacatcaaagcacattattgagttaatatgaacaagaccttcacgtgggaattgaagtcctcacagcttgacctactctcatcccttagaaacaggtcgacaaagaattggaagcctctttgcatatgatggatagagaagaaaaaattggcaccacctgtacttttgaatatctttctttttaaaatagaattaaatttgaggtgggaagaaacaagggtggaaaagagggtagggatcagaatggaaatgtatgccaagtagatgatgacaacagcccagttaagagtggatgaaagtctgaactaagaaaggagcactgggaatttgtggagaggctgaattcatgacaggttatagaataaaatcaatgctacttttgagccaattgaatgtgagggctagaggaaaaggaaaagtgtaggatttttgataatggccctattagctgtgcattcatggattcatatttgtgtatatactatgtacatatttatactgtgcattgttctgtaaaggctttagggcaacttataacaatgtataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggccgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagaccctataacccagaaattctaccccttgatatagtcctcaaaggaatgcatacatatattcatcaaatggcatgtcttagaatgtttataacatcatttttttctaccaaatgcccatccacagtagagtatataatatactgcaggatattgacacaatgggatattacatagcaattagaatgaacaatccaccacttcatacaacagcatggatgaatccaggtttaaagaagtcagacacaaaagagtacatgctgtgcaatttcatttatataaaggacaagaacaggccagaatatttaatggtgttcaaaatcaagattgtggttacccttggaggacaggtaactatcagaagggcacacaaagggccttctaaaggttggtaatgttctgtttctttatttggatgctggttaaatgagtgtgttcagattgtgaaaattcactgaactgtataagtttaagccattttttctttttttttaattgacaaataaaaattgtatatctttatcatgtataacatgttttgaaatatgtatacactgtggaatggctaaaccaagctaagtaacatatgcattacctcatatacttatcatttcttatggtgataatacttaaatctactctcttagcaattttcaagactatactagattttcattacctatagtcaccatggtgtacaatagagctcttgaacttattcctcctaaccgaagtttcatatcctttaaccagcatctcccttattttctacatgcctaatatatttcagtaaaaaagtgttttaaaaggtgggtataatttggttgtggcctttgtagatgtcaaagcaaaagaaaaaatataaaaggaaatatgatcgattttattatttggattattgataaggaggaaagagtgtaagtgaaacaaaggaaaatccaagtctggaatgacttagattgaataaacagatctgcatgggatctaaggtgggagacactgcatggtgtcgactttcagaaaaatcccttcagcagttttcagtgcccctcgacataagccaggaacatgatgccgaggtacacctgagttgaggcaatcttatgggggccaaggcaaagtggtctaagaatgcagctttctgatgacctggcctgaggtggagataaaactaactacagtgtttttcaaactgcaggtcatgaacccttagtacgtcatgaaatctatatagtggatcattaccagtattgttcttaatgaaacagaaaagaatagaaaatatgacagtgtagaggttggagtggggaaaatgggttataaaactacctattgggtactatgctcacaatctgggtaacaggtcatgagccccacaccttagcatcatgcaatgttcccatgtaacaaacctgtacatgtacctcctgtatctaaaatagaagttgaaattaaaaaaaaaaaaaaaatatgaaagtgtactatttggtatgggtaagtaatgttttgtgaaacttttctttcaatcatacaagcatgaatagacagaaaaagatttacagatatagatgcgtgtgtgcgtgtgtgtgtgtaccaggatgacatataaaattaatttttatagtggattggcaaaaaagatgaaagctacaggctttactacataaagaaatggacaaactatacatgcccactggacaatcatgcatcattataatttctctagactaggatttggaaagaagttgacggaagacagtttgcagtcttattccctggtaagggctggaacattacaagagactggaggaggattaaaagattcaggagggggagcaagttggggaggcgttcatcaagtctgaagttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatcttgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaaattcctttcaaaagagtgaccagctttgaaagttaccagaaggaaacccacaatctttcttttttcagtatttaatcacagcagctttcattaaattcccagtactaataagtggttaactatgtttgtaatcagtatttcttatatttttaaaagcactagattatggatgctgtatgtctaccattggctgtgaagccacaaacagtttagcctagcaatgattactcacaaagcatgaattttaacagcacactccattttacctacatctaaattcagaagagaatttagtccacagaggaaccttcctgtaacttttcttgaatattttgtgatatcttgcaacatggccaaaagttctagccctctccttggtgtccagctcttgcagtgtgcctttgtatctcttcccaccaacaggtggagtctttccccactccttacatctgggatggccctatgacatgacttgcttcggctaatggacactaccaaacatgacacaagcagaaacctgagaagtttccatgtgaactagcctgaactagcatgttggatgatgagatacacacaaacctagttgcatctgttcctagatgacagcctgtcaaccatcagacatatgagtcaggtcacgatagcttatccagctgccagctgactacagatgcataagcatgcctggcaaacagtagtacaactggtcacaccacataaatggcccaatccacccatcaaatagtgagctaagtaaatggctggccattgtgttatagagtttatgaactattgttcaaatttggtctatggcctgcttctgtacagcctctcagctaagtatgactacatttttagagttgtaaaaagaaaaagaatgtgcaacaaagatgcaaagtgctccacaaagcctatagtgtttactatgttgtcctttacagaaaatgtttgctgacctcagtgttaagccagtaagttttggggttggtctgttatacagcaaaagtagctgttacacatctgctcccaagaaagaacgttagaaactaggcctttctcacaaattcagttagcacctagtcaatttatccttggtgcatgtcctccagttgcttgttaataagataatgctgaaatgaacagaaagaacaaatacacatataacctgggaagttattttagtaatatgcttctcaaaagtaagattttataaggggtatttagaaaaacaagtatacaatttttagcagtcttattcataatatcctcaagctggaaacaaaatcattatgctgaatataagagaccagatacatacaaaaatactgtatgattctatttatagaaaattcttgaaaatgcaaagtaatacacagtgagagaaagacgatcagtggttgcctagaatcaggggtgaaaggaaaaatgacctgcaaaggggcacaaggaggcttttgggggagtaagaacgttctgtcatttgactgcagtggtggtttcacaagtacacatctgccaaaaatcgctgaaccactttaaatggaggcagtttactgtgtgtaaatttttatttaataaagtttattttaaaatttttttaaaaaagcgtttgccctaaaatcaaatttaacattcaaaaatgcatacaactgcacaaagaatgaggtgcatcacacaggatgtttacataaatataggacagattcaggtcatgctgtcagttcccttctgattaattccgaaaatatcaaaacattagattcacaagtgaccttaaaggttaatgaattatatcctctcatccaatacagaaattgcctttaggggtgagacagtcatttcagtcttgaaaatctactgtacagggagtttaatgcttttcaaagtggcggattttattttttggagagctcgattacaaaagtttctttaatatttagttaaaatatgctttcccataacttccacatatctagctcaatccattctcagaataaaacaggaaaaaaataacaaaagagagttcacagtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgttgctcatcaacatcaaacttattggtttgtaaattttaaaattcatctctttactttttaaacgttaaaaaaatgttttctaatctccttatatgacatcaccaatcccttcccatgttttctctgagttttccactggcaactcttttcatgggaggaggagtgacttttagtggatactggataagaagaatgcactcctgttgagtagaatgagatcccatggcagcacttctaacaaattagacctagtctctgaacaaaaacaatatgagttaagatcgtccctaagattatctagaaaagaatcccgttcccataaagctgagtaacattttggtcagatttgtgtcattttaaaagccaaaatatttacctaaaaagcaagtgatttgaatgtctcagactaagttattttttactgatctatggccctcaaatgagttgatgaccttcagtagagaaatggttctttatttctgatttgtgagagtcatgcgacagcagtggatgggttaagaaggttagaggaaatttgttacattgctttttagctgttgttttttagtttggtgaacaaacgagataacatagctagtgccttttagtcataaagcaaaaataaaactacagtgttttctaatattgtaccctaaacctatgcaaatctccaatttacatcacccacaagccttctatatttttgcagattttaactagagctaaataataggcatatatttatacttaattgtaatcaaatgtaatgacgtgtgcaaaacaggctttgctcaaagtgctctttatagatgaaatatgattattgaacttgacagtagatcattcattggagggaaaagtgattaatcacttctctgtgcctctaccttcctaccctttgatgacaccggttatatttcaagattctcaatgctataaatgaacactttactgaagaagcatctttatccaatgcaaaatgaaatgtgttgcctaagactaataaagtcatttacaagtttcaatgaggagcaaatataaatagtaaaaaaaaaaaaatccattatttaacagcagtaaatccagtatgttttggtaaaacagttttcagagaagctctacttacgttagcttttcctaaaccttgctgcaaagtgtcagttctttctaatatacaatcaaaggaattttgtgttgggaagaacatttctcatctttgtaaaggacatttagaggagagatagggaaaaacaaagatcatgcatgaggattatgtgtgagggtatggattgactggatttcaatcattattttaaaaggcttatctaaaataaggtgttctttgaaccaagtggagtctgatttccaattttagaatgtttccacatttaacactgacattcattatcctgaaaatgaaggcagatacacataatatctatatgtattttaaataaaattggttcaataatttttctcaaatttcataactttttctatgaatcaatgtgtcaactcattttttcaacttttcaaactgaaagaaattccattgatctttaataataatgaatttaatcaaatattaggcaaaattctttagtgaaagaactcagagaatttgattaggtgcctaaaatgtcatttttaacataaaaattaacaaaagcacaaaaatatttccattttatcttaaaaattaacatgctatgttataatacaaaaaaagccctcccctaccccagaatcctgcataagaatgtgaatggttatgtttgtttgcgcagatggggtttatatttatgtgtttcttttccatctagcaaatttaaatctaggatacaaatgtagtcattatcgtgtctgaattggtgaagaaagcccaaaatatggccaaatctacttgccccctaccttaaattatgagtttttaaaaatatattttcaggttagaatatttctcttttttctgagtttagctctctgaagcaagtgctatcaattcatgaaaatattaattataaaagttttatactgacgatttggtcctcataactgcccctgcttggtctatatttcaccttcatcatgatttattttctaatatgagattaatgttaaggaccataaacgttatgttgagaatcataaaacatgtgtgctaaattttgggaacagctcacgtatacagagaaagaagaaaataaaaagatctagcagataaagaaaatactgtttttggtcccatttagaaatgttattaacggcaatgctgtaacaccttcctttccaacacaatggcaagccatgggatgaacaagctcaagacatgtgtggtagcataccaattaagcaaacagttgactcatggatgcattactagcaatacttctgctccaacccagatacagatgctcttcaacttacaatgaggttatgtaccaataaactcatcataagttgaaaatattctaagtcaaaaatgcatttaacatacctaatctactcaacatcatagctcagcctagcctaccttaaacttactcagaacacttacgttagcctacagttgggcaaaatcatctaacacaaagcctattttatactaaagcattgaatagctcatgtaatttattgaatactgtactgaaagtgaaaaacagaggggttgtgtggatacctgaagtatggtttctactgaatgtgtatcacttttgcagcattatcaagtaaaaaaatcctaaatccaaccattgtaagtcagggatcatctatgtttgattgacaggccccagcaagcatccgcaaatgaggaaagaatagagagaggagaaagaaagtactagatgaagacaaagaatccttggtgataggatcttcagacagagaggctctagggacttgaaacctggaagttcagcataggcatttagtatatgttgagccttagggaactcatttatcaatttgatatcactcctttgtatcactgccatggtgaatgatcagaaaggaaacacaaactccttctttaagaactgcaataacgaactgtttcttcttcttcttcttcttcttcttcttcttcttcttcttcttcttcttttttttggcagaggtggggtgtctcgctaccttgactaggcaggtcttgaactgctggcctcaagcaatgctcccacctcagcctcccaaagtgttcggataaccggcattagccacctcctctggccaagaactgtttcttttgattaaattttgttcttcctactccaactttccttaaagataatgcttccttaaagataaatctaatggcttaaacacacacacacacacacacacacacacacacacacacccacacccacacacgcaaagtatgtattcttttttatcactctcctcctgtccctcttacaccttgctttggaactgactggtgccttgcatctccagtcatttatcacacatcgtgtagaccgagattttcgatattaaaacattcagtctgccaatgtacgtaggaagcaccctcaatgtctttaaaatgctattctgaaacatttaaagagggccatctgcaataagaatgatcattagatgatgataaacagtactgggtcacagatggagaaagtaatagtatttgagagccattttcatgttaatgttatagattacatattaaagaaatgtgccagtaatgaagcaaacaacaaagagggccattggagaagaacagttatgctattgaaagcaatgatataataagcagaatggccccaagccatctgtttttaaagcttaccatatttaggctgttaggaccattccactgtccatggaggtgccattctgagataacagggaagtgggcaaaactaatacaaattaaaccattgtcagtaatttttatcataaattgatttttccctctacaaacatatctaatgctcccaaatctgactatttaaaaaaatgtttcttagtccttaatgtatgcatatcacaactctgaagacactagaagtatagactatagggttcacagtcttaaaatgaggattttagatattgattttcattaacgctctcctctaaaatagtttcagtcttttgtgcttccaaaattagaactttatccttaggttttgcaatttggatcttgtaaggagataaagagggaagaaaaaaagtttgtgattcaggggtgtaataaactccagctggcatatcatgagcctagttatgtcaaaataaataaatgatcaaaaatcttattaaaaaacaaaaacatactggaactttggaaaataaatttaggtaaaacaagtgaaatgaaaataggaagaatattaatattcagaagctgattgattatgtattagccagatcaaagcctctgggtgataatgagccactgaacagggattaccacctgtcctgttcaactagcagctggacttaccaagaacagctggacaagaacacttatataaaattagcctttagaagcataagctaagttttttcacctgcttctcagatcggcatctttatcactcatgccagaagtaaaaagcttttcatattttgatgctgtttttgccttcaggaaagcacagctttgaacaccaatattcccagccgcttgctaccaagtaatggaggttgtcttctagacctaataagctaagatgtcagatgcacttggtttttcctgtcactggctcatcttgtgctcttatgtttaagccactacaaattctttcaaaagaaagtagaaatataaattataaagaaagattttaatgtcatttattcctatattcttactcacgaatcttcattttattgaaacctatttaaaatgacaatatatatgcacacttgggaagtttatcagataattttgatataagacgataggttaaaaataaggcatatgacaatctttatttggtgctctgaattgtattaaagtcaccagtctgttttaagagttatcatggaacaagtgaatgagtaaatataatagtctacttccttccttctcaaagtgtggttggtccacagattagcagcattagcatcacctgttagaaatgcagaacatcatgtctcattttagacccactggctcataatctggattttaacaagattcccagacaatttgtatgcacattaaaatttgagaagcaatgttcctgtgagcttaatcagatcctctctttctttctacacgttttttctttcttttttttgagacagagtctcactctgttaccgaggcttaccaaagctggagtgcagcggcgtgatctcggctcactgcaacctccgcctcccatgttcaagtgattctcataactcagcctgggattacagctgggattacaggcatgtgccgccatgcccggctaagttttgtatttttagtagagacaggtttcgccatgttggccaggctggtctaaacctcctgggattaagcgatctgccctcctcggcctcccaaagcctgttgggattacaggcttaagccaccatgcctgtccctgtttctccactttgtattggaatgcttttatttgaatatgatgttttagtacaaaccacagcctaggaggcctgggttttaaagtaactaatattgatggctactatgcctgctatgtataagtgtaacgtacacaggttgaacataaagaggaggtttcacataagaatattataggaggtatcgtgaccttagaacatctgtacatctgtataatggaacctatttctttcattagaccccaatctgaaaatttctctgtctgccaaaagaaacagagaatccttctactcccacaacgcaagagaggaaaagaaaaacacattctaagtggcaagtaactggcagcaggcactttgtataaataccaaaagtagcacgcgttagcacattgatgacgactccttatttcaaacctgcacttggaacaactgcagatagagactaataattcttgtcaatgtgtattaaaagctctgacaggagaaaacaacttgtgcagctcaagattgaaagaaagcacaatgaggagattcaattaaaactggatgatgggagaagaaagcataatctataggaggacaggtataaatcctctttttctgatttgtccagtctctactaaaagagattgaaagctgatatcagaatcctttgccatgctagttataggcatttatttatttaggtatttatttacattttttaattatatgcttttatgtataatcatgcttcaattacgtgtacagcaaatggtaaatatttctcatttatataacatgaggtcagtcattcctaatgaatcttttctggtgccttaaaacctcccaattaaagactccttcaaatactccagtcaaagacaccaattaaggattcctcttaatagataaatatccaaaccaggctgtcctcaaaatgataaccagtgtcaagattccagtgttcaaaaaagacagatcagtaagcagtctcccaagccaattgactgtgtgccaattccacccttggttgaagggagagaaaatgattgcttcagagcagaagcaacggtggaagcagaagaaacagacaaaaaaaaagtgggggcgggagaggagagagggttaagatgcaatgggacagtaagatgttgtggagtagtgtgaacccggaaatcaattgggaaatagaacatcaaaagaacacgccagtatttttgggtttttgtttgctcctctctaaagaaaaaattctgtctaccttagacaagcacttcaccagttaagtctgtgggaagcatctacttagggcaggtaggccaattggtatcttcaatctttttcaaaggcttaaatttaggcacatccaggagtaagaaagtccttcccttcactacgtgcaagataaagctggtcaatcgttgagccccagctgactaaattttatgtcaggtaaaggaagcaatgtgggtatgttcccgacaatttatcagataaccaagtacaatcccattaagataacggctatagtccttgaattgaagacttatagggccatgtagaggtggcttttgtctaaaaaggacaaaggaactgaataatgtggtcagttctctgccacagagacatgaagacgaaccaagagattttatgtgtgtttgctcattttgtcagaaacaacaggtgacttaattacatagacttcagttcaaaatgctaagaataactgacaactgacaactttggaggacagattcctaccaaagtaatcacattagtgctgctctcagtcattcaattagtttatgattttcaataaatgaataatcatataatagaataatccaaaatcttatttttaggttttttgtatatataactagtattaaccctctctgtcaacatttttgctttccttaaagaaatataagaacataaaattttagtctaggtgtggcggctcacatctgtaatcctggcacgttgggaggtcgaggcgggtggatcatctaaggccaggagtttgagaccaacctggccaacatggtgaaactctatctctataaaaatacaaaaattagctgggcatgatggcgggtgcctgtaatcccagccactcgagaggctgaggcgggagaatcacttgaacccagcaggtggaggttgcagtccactgcactccagcctgggtgacagagcaaaaaaaaaaaaaataaaaaataaaataaaatccatctcaaaaaaaaaaaaatcaaaatttaacactctgatataccattataattatttattgtaattgacaacgcaaatacaattttgcttatttggttgttctgttcgttgtaaatggagtacaaattctaatttttgttagctctaaatcaaattttaaaagtaaacagaatgtttaaagttatgttttatttgcttaacataacacttaaaacaagatgaacagcaaaatataagaccaggcctgaatccactgagctgtctcctctatgaacttcataaggcatcttacatagagtaagcagacagacttccagacttacagttagaaaatgctggtttgaacctgggctctaacactgtgatactgggggaaaaaaaatcacataatgtattgaaataataagtattgttgactataaaatggaaatctatcctacatattttacgatattcttttaaaattaaatgaagtaatatatgcaactttatgtaagtaggtactttataaactagaaaattaaataactgctaatttattttttagtttagtaaagtctacaaaaacatcacttaactatatatcaaatatagtcacttaggttattattctgtttattattattattattattattattattattattatttgagacagagtctcactctgtcgcccaggctggagtgcagtggcatgatctctgctcactgcaacctccgcctcctgggttcaagcaattctcatgcctcagcctcccgagtagctgggattacaggtgcacgccaccatgcctggctgatttttatatttttagtagagatggggtttagccatgttggccaggctggtcttgaactcctggcatcaagcaatctacccgcctcggcctcccaaagtgctaggactacaggcatgagccaccatgcccagtcttatttactattattttattattttaaaaatcctaatttcctgaatttttcctggaaatgcagataagtaggtaatgcatttggtgatggtagtattaatagtaatgagctaatacctcatcctgaaaatagctcaaagattaccttaagtacatattgactccctaaatatgtgaataacaaatataattgtcacataaatacaattatgcaatcatgtcaactaaatacaatttgcaaatattttgattgtttaaggttgtattttcagtgtactatttaacagttatacatatcttattagtctacaagactttagactacaaggacagtagtcttcatggtccctacctgcctagtatggcagctatgattatttgctgaatgaataaaaataatactctaaaaagtgtgttcatatgaataatttttcattcatgatgcctctatcctaagcatcttatatataggatcttaatccacagcaatctgaattccctgcaaaaattaaaagaagtctgatattccttcactctatataaccttgaaaagaaacaaggcaaaagcaaacaaacaaacaaacaaaaaatccagtaacttgaaatgagactaccaggtttgctttaggcaaggtaggctatgaactaagcaattttaaagcttggagtgaggacaatttaagtcaaatcagttttttggaatgtccacaagacactaagtatatcatgaaaataacatttaaggaaaaataagtacacaaacatgagagtaaatgaaaatattctagttatttgcagacttggatgtcttaaaatctaaacttttttaatatggtaaattaaatgacaaattcatatttaagtgtaaattaaataaatgtcaactataaatgaattatattatttgaaaatggaattatatctgtgctattacgcttttcattagttgaaagtacaagttgcaaactagcagactttgggctaaatttggcatgcacaaatgttttgattagcccacacagtttttttttttttaatctgaattactcaacatttaaatattcagagatattttacagaataatccaaccttctgacttctcatttaaaaggaatgatttgtccatgctgggctcctattcttgcatgacaataactttccggagccaccattctataacggcacatgtattctatagtccctaccagctcccattaacttacgcttcgctagccttgcccagttacagtagcaggctagcccctctgttggcatttcagtttgcaacctctggtttagaccagcaaaggctgaccatagcaatcttagagtatcttagtgtgctttaagtcaactgacactgacaaaagaagaaatagaaaattggaatagccctgtactatttaagaaataaacactgtaattataaattttcccactaggaaaattccaaggccaaatcatatcactggcagaaataccaatcttaaagaaactcttccagagactagaagaggcaatgcttccctacttgcctttatgaaaccagaataatccacataccaaaccttgacaagaatggcagaccaatataactaataaacacagatgcaataactctaaaggaaatactatcaaatgaattctaaatgaatgtttagcatcaagtactgggccaactagatatccatattatgaaaaataaaactcaatctctatctcacatattacacaaaaggtcaattccaggtgtactatatatctaaatggaaaagttaaaaaatagtaagtttctagaagataataaaagaggatacattcattatcttgtattaggaaagatttcttaaagaggacacaaaagaattaaccctaaggaaaaatttacatattggactatattaaagttaagaactatcaatcaaaaaaacaatttaattaaaaggaaagctataaaatgggagaagatatttgcaacacatacaatttacaaagggctacaaactagaatatgtaaaaaaaactcctacagatcaataagaaaaagaaggatgaatcaataaaaaaaataggcaagagactgaatagatacttcacacaacaggatatccaaaatggtcaataaatacacgtaaaaatattcaacctcataagtaatcagacaattgcaaattaaaataacaatgagattctactcacacactcactgcaatggcgaaaattttaaagactaacaagtatcaagtattgttgagatgtggagctactagaactttcatatactgctaatgatggtgtaaactggtacaaccactttggaaaaccaggagtatctactaaagctcagcatatgcctaccctcaacataggcaattttactgcaaagtatataccaaacacagttgtacacacgtgtgtgccaaaaaacgcattaaagaatgttcataggaggccttattcataatgtcttcaaactggaaagaaccaaaatgttccccaacaatagaatggataaattatagtatacattttaaatgggatatcaaattgcaatgaaaatgtatgacagattcatgcaacaacatgagttaatctcataaacacaatgttgagtcctagatacaaaaggttatatactgtacaattccatttttatagagttcaaataaacaggcaaaactcaaccatagtgttataaggcagagtagcagttacctttaagatgagggaggaatagtgattgggagagggaatgtgggtgaggtagggtggtgatttctgaggtagtggttatattctatgtttctcctcaagcttttcattttgaaaattttaaaccaattgaaatgttaaaagaacacccataaaccattcacttagactccccaactgttaacataatattcgctttctctctctctctctcaccactcccccaacccggtgtgtgtgtgtgtgtgtgtgtgtgtgtgtagtctggtttagtgtgtgtgtgtgtgtgtgtgtgtgtgtgtgtgtgtgtgtgtaatctggtttagggctactgataatgttttatttactgtcctagatggcgaacataggtgtattcattttgtgataattgcattgagctgaacatgtttcatctgtatactttctgaatgtgggtcattcttcaagcaaaaaaaagagattcaatcaacttattttttgaaaacgccctcgaaaacaatgcattcaatacaacacattactgaaatactatgggtaatgattttttgttgttgctgtttagacagcgttagggaaaaactacaccatattttctgatctatttattgaacaaggatacctcaatgtggcagtgaggcttgggttaaaattgttatgtcacagcctcacctgctggttgttttccgtagccatactctacacttgcttctgtattatatggagataagaaatctccccatacttgctgcttttaaaatgtttttaagacaaggttgttcagggcacagaatgagacacagagcggggctatgggggttactgccagtgcagggtagatattaaattgtcctatcagttaatcgactaagtaaaacacagttctgactccccctgccaaacaaatggttaaacgagcaagctaaagaaaggacataataggccaggtgtggtggctcacgcctgtaatcccagcactttgggatgccaaggcaggaggatcgcttgagccaaggagttcgaggtcagcctgggcaacatggtgagactaccccctgctgccatctctacgaaaagaaaatacaaaaaaaaggaaagcacataatattttccaaagcttagataaaaagtaggatagatgacctgaggatgaaaaagaaacataattatagaagtttttcctttgtgttgtttaccaacagaaatgaattaacaatacggcacaacagaacaaacacacagcttagacaaaagcaacttagtcccagattctagtccatagcaaatgatctaagatagatccagacatctcaaagcctcagtttccaagtctgtgggaataagaataatcatatatgatactcaaacattccatgggatattgtaagaatcaagtgtgataatagaggtgaaagtgttcgataaagtgctatacaaacacatggggctatctataagttatctacctgaatatatcctctacccgaacatccatggcattagaaagaccatgggatcaggtatcagaagatctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatggcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctcggctcactgcaagctccagccccgggttcacgccattctcctgcctcagcctcccgagtatctgggactacaggcgtccaccaccacacctggctaattttttgtatttttagtagagactgggtttcaccgtgttagccaggatgatctcgatctcccgaccttgtgatccgcccacctcggcctcacaaagtgctgggattacaggtgtgagccaccgcgcccggccgtaggtttgcttttaatatactttcagaatgtgtgtgttagcatttttttttcatataacagctttattgacatttagtatacataccatacgattcgcccatttaaggtgtacaattcaatatttttgtttgtttgtttgttgagactcgctctgtcacccaggctagagtgcaatggcatgatcttggctcactgcaacctccacctcccaagtccaagcgattctcctgcctcagcctcccaagtagctgggattacaagcgctcgctatgaacgcctggctaatgtttgtatttttagtagagatggggtttcaccatgttggtcaggctggtctcgaactcctgacatcaagtgatctgcccgccttggcctcccaaagtgcttgcattacaggcgtagccaccacacccggccttgacttagtactttgtattggtgatatatggaattgatttcaacattttttgccattctagggtgaaagtgctacaataaattaaaaccttataccagccaaagaagaggcagctctcaattgtgaatgttgagaatatacttacaagaaaaatttaactttggtgatgtaatagcttcatttgcattacctaaagcttgaagtcaaaagctaaagtattaagcgtacagaagcatggactctatgaaagaaacaatccaaaaagtgacttttttttttttttttttttacaatgggagacattaagaactttggtaactaactcttcaatatgtccctgatgacagaccaaggatttatgaccagaagaagctattaagaaaatcttcctgaggtgttaaacattgaacatggattattcatgaaaagataggaaatctcttttctgaatcagaagagagtagattcttgttgatctggagtggtttccatttacttctgccatgggaataaactgaatgattgctctataattgaatagtcttttaaaccatactctataaattctataactatcttataagtatggtatctaaaaataagactgatagcttgaggactcatagttgtgaaaaactattgaaagtatcattgaaaaggctcaacgttttctattttcaaaaagctaatggtaagctattttttaatccaatggatgatggtttcagtaaaggcaattttgtcacaaagatttttatgggaatctgcagtatgtagaaagattctcctgaggaaacgtgcttactgctccctttacagtaggtcaagagtctctgatttctagcacagaactattttctaggcatcttttaaaaccctacctaaaggcagatgagtgggccctaatgttacaaagaactactctgagctaagtgaaagaattacagttggacaagtgggaacaaataacatggttcatagctgcaattactgctcacatgaattttacttataatattcctgatgccaagtcataaatgctctcaacatctcatctgactggtagaactttcttactggcatgagattcctaggatttttgttatcctttagcttttatattctacaccatggattggtaccactctaaattggatcaaattttggaacaatagacatcaagtaagatgtttctaaacaattagctattcttagtcatttgaatttctatgtcataacacatgctttggcatttatagagtaacctactcttaagaaaaaataatctcttctaaagcccgtatttaattttacaattgtgtatacacaattgtgtatgtatatagtaagcatggtcactgacaaatgctaatgtctcagccagggaaattgattgacaggaaactggagaagagcccctgaaaactcaagtctgtaattatatactacatctgtgagtggactacctgtatcagtttatacaccatcttccaaatcccaaagtttagtggtaaactaaaccttgtctgatgccctgtatggtctaaaaaagaggagaggggttgaaaagagcaagaggtagagtagagatgcaatctgaagaccgctattcccagagtgatagagcaagtgactagtagtgaatgtgagggacctcctgtttgtgtggtttgtctgtcatataaatcttgaaacttacatagatttttataagggaaaacatcagcatatcgagaagaaagatataatgtttaaggggatcattgccactggactttatttagattttggcttgcacattctatcagaatgaaaagccaacattgaaatcttttcatcatataagagaaaaaggaagatagtaggtgctggtatcacaaggctagaagcggttttcatagtagtcagccattaatctttcccttatgagtttgagttatcctaacattgtgcatattataaatacagacacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgatagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaattagaataataaggaatgctgatgcacaaaatacaggtttgtgaatcactactgagcctacactgtcaaaattaattactacggatgaggatttggtacttttctttttttaaagaaagctttagagtagaacagttgtattttgacttaaaaggaattgaaaactctctcttttaaatttgaaggtaaaaaaaaagcacatctccctaacagtacacataaaaactaactgcaaagagcaaaacaaaagttggaacctagggtcagatatttctgagtaagaactgaagaaaagtcaactaattgttcgtttagaaaatagggtaggctgggtgtgatggctcacgcctgtaatcccagcactttgggacgctgaggtgggtggatcatgaggtcaagagatcaagaccatcctggccaaattggtgaaaccctgtctctactaaaaatacaaaaattagctgggtatggtggcatgcaactgtagtcccagctacttgggaggctgaggcaggagaatcgcttgaacctgggaggtggaggttgcagtgagccgagatcgcaccactgcactccagcctggtgacagaggaagactccgtcttaaaaaaaaaaaaaaaaaaaaaaaaggatgggggggatgatacaggtaagctatttgaatatttcaaaaaataactatctgaggaaaaagtgctgcatatggtaaataccttgatattagatatatttggatttatgtgtccacacaaggaaacagagaacatttaaacaactgggaatatacaagaggaaacaaaaataattctattctctccaatggtaaaagattgagttaccttaaaataaagatttttttttcacctgcacaaattttaaagcaacatctgaagatgagttggaaagagtatgttccatatttaaatttgtttccacatggtttgctgcaaagactgcgtcggttgattttattttcgatgctctacatttccattctgggtcaccccctattcagtgaaatcattttatgtcattggtgcagccaacaaaaaaccgatggtgtatttgctggatatggaaggtgcaacacgcatttttcatgttacaaaaatcttcctacagaagttccaaacctgttggatttggcaagatatgatgaagggagatgataccaatactttatatagtttctagagtaatccttgaaagacttgtattctgggtcttcagtcaagtaatattatagggtctgtagaactatcaaattacctgtgttattgaggtgaaaggtgaatttgtggtggccttatttgtctacctgatattaagccaagggtactgcacttgggaagacagctgacatctgccgtcaaaaatgtaaagtaggaagttagagtatcttcgtatttaggtttaaacttgcattgctcaagaaaaggtaggatacaaagttatataaacaatatcttttgtattttatcagcagattttaaaaaactggaagaagacattaccaacatgttcattgcagttgtctaggtggtgatgggcacttaaatatttttaatctttttctatgttttccacagtgaacatttattatttttgttatgacacggaaaacttacaaatattaatttctaaaatgtattgctcagacttccagtttcaacttggagatggagatggagagctgcaaagaggttgctcccatacttgtagcaagaaaactgctggacagataaattaatgacttttcatcagtccatcagagaaatgacattatagaacaacctgaaatctggagagagattggcctttagccagaagcagtgcctgagcatttggatccctggagcagatgccatataaactagtagggagattaaattgttgggggacatgtgggagctagcctgagagtgtgaagatcctgggggctactgccataggtggagtcccaaccttttgcaagcttcttccttcaggaactgtaccttgccttcacaaggaggatgcgaagaatctggagaaagcctccccaacaccctctgtgttgctgattggggaagggtcacagtagctagtcaccatgaatctgcttatacccttctcttcagaggaaaagacatcacattgctataaagaactacccgtgactgggtagtttataaagcaaagaggtttaattgactcacagttctgcaggctgtataggaggcatggctggggagccctcaggaagcttaaaatcatggcagaaggcaaaggggaagcaagcacatcttcacacagcagcaggatagacacagtgaaggggaaagtcctacatactctcaaataactagatctcttgagaactcactcactatcacaagtacagcaacggagaaatctgcccccatgattcattcacctcccatcaggcccctcctccaacatgtggggattacaatttgacatgacatttgggtggagacacagaaccaaaccatatcaggcactgaggaaataccactgcattttaggggaagggaacaccagatctcatctatgtgtggttttgttttgttctttttttgtttgtttttttttgtttgtttgttgttgttgttgtttttcagccttatgcaggagaaagggccttggggccatagactgagaacactggtggatatccactgcagctccaggaagggaatgggaggttgaagttactctacctctggaggaagggaaagaaataattgtaaagaccacatccccaagacccaggccaactgtgtattaattcaaacattagagaatgcctctgcccgacactcaaccactacactaacaagcttccaatgaggaaacaaagttaccagaggaatttgaagtctctggtggccacagcagcaacaaaactcaacaatgacaaccaaagcaactaccaacatcaaacacagcccaattcccagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataattaatattttaaagactcttgagggaaaagaaagacaatatgcaagattagatagaaaatatgtaagattagaagacaatatgcaagattagatttgattcactcttatagtttccagctctatatttcagtatatttcagtatagagctggaaactataagtgaatcaaatggaaatgctagaaattaaaagcagtaacagaaaagaaaaataccttagatgggctcatctgtagattcaacaaagacaaggaaagaaccagtgaacttgaatatagggtaacagaaattatacaaactgaaaagcagggggaaaagtaaaaaaaaaaatgcaattgcaatacaaacacagtaggttttcagtattaagtagggctctaggaaacagctatttttcagattaagtaacagtttggtgcaattatgctgatcaagcataaagaactataaattaaagacttcactcaaagaagacctctgacaagcaaccaagttgctacaaagtatttaaaaagctagtgaccaaccagttgtttacagtgatatattttgcaatatttgatttagattaagagttctaggaaatacaaaaagatccacagtacaaaaaaacaaatgtgttccttctaatgctcagaattaacattttatctttgctcaaagcttcttttgaaataaaatacaccattcaagatgaaattccgatcctctctgatgccccctctcccatactacaactagtatcataactttggtgtttatctttccaggcttttcattttaatttaatttttaaaaattagtcttttttatttttagtattgcacctgtacttcaaaaagcaaaacactttaaaaagtgaccttccagaatttagcatcagaatctcattcacactcatggtttcagttactagctatatacaagtaatatgtaaattagtgactccaacccagatgcgcctccttctttctttaggtgcacactatctgtctatttacagtgctttttggatgtcaccaatcatttgaaatccaaacatttacaatcaaattgccaccctaaatctgatctttctttagagttccctaactcactgtaaagaattaccaactgtgcattgcccagaaatctaggtgtgattccttgacatgttttgctttctctttgcgcccttcctcctatgatatctatcctcaaatcttaaggatttttacctcctaaaaatctctcaaatctatgcctttctcaccatatccaaactatcatcatcttggtccaaatcccatcttctctcacctggctttcatcagtaaccttcaaacgtttgtattcataggctcctcatccaattcatttgcatcagccagaggactttttgagttttctcctcacctcctccagccctagtcatgctgtccttttaatcccttgtattgacaagttccctcctgctaaattgccttgacacatgactctctctctctttttgtgttaatatgtattcattcttagtgtcatttccattatctattccctggctatactttggaggtatcatgcatgttgctcaccaaatgtaccctttacatctagcaatgtatctggtgcacatattctgataaataaacatctattgacaaatgaatcaatgaatgaatcagtcaagagtatatctttagataaatgtttttcttaggtaaggagaatcaaaccatttaagtgcattagaattaaaaagcattttagcatttgtgagaaattctgaaagcagtaacaagtagcagtttctacttttacaaatataactgaggttaaacaaaatatacccagtaaaaaataacttcttactaacttggctaattatgggtgaaattggtcatttatgctgtgacaatgatcagagacacccttggaaactatgcttctttaaggaataatgatgccattttatagttttatgctttcattttagcatttgagaacagttcacaaacacactaattaatctctgcaatgatattgtactcctatattacaggccaattcaagaaagtaaatcacacagatttcaaaagcataggaaaaatttttagatgcctaagaatatactctttacctcctgtaccttgttatatatgtctttatagtcttagatagatctttaataaagaattgaaacagaaacagagatccttattttagctcctttatgtaaatcatatgcatatttatgacttagttcctttattttgtgagcattttatatatatatatatataatataaaatataaaatttacaatagctggtacaatagcccccaataaatatagtttgcttaattaatgtaatgaattcattaatacatttgccttttgcaaaacagaaactagctcgatattgtgaagtcccagggtttcctccctcatcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacgtatccattacctcaccaacatatcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaagccgaggagacacctggattgccctctttctgtccctcctgacctccaatgcatcagcaagacctgtgattgtttctaaaccatattccctgattccaaccacctcttgtgatctccactgctacctttatctagatcttatctaacaccagtgcttcccacactactatctggtctccctgcttccactctggctcttcatatttcctcacccctaactcacgtgttccaccaaatgcattctccacacagcagccaattatgtcttgccaatctagtctactttcaaactgcattataacaaagcaccagcaaaaaaccaaacacctccaacaaacttcacctaggctttgataaaggtcaaggtttgcatttcaaaaattttcctctttggagttgcagaaaagaaatattcagggctgaatttcagcaaccttcttattagtatttacaaactagttatacttggctaatttgtaacaccattgaaagtgaggtttggcaataagtgtactttacattgtgaacattaaaaacaaacaagacatattgtctggcaaaatattttttgctgttgttgttgttgtttgaaattgtatatatttgaactaccttaaaagataatcagaggaagtcccaggtagctggacatttaaaagtttgtcttttttctttgaaaataatacatgaaacttggaaattgggaaaacatatttactataatattcaagtcaaagaatggagaattgcccaattagggtttatataaaattagttttcaaatttaaaaaaaaatccagactaaattatatctttataatgtataacccttaagagttgtttatatatcttctggttggttcataagcggaagagctgctgcactgttcagtatcatttccccatatttcactgagaaatgaagttcagagagtaatgaaattatgtaagggcatacatattattttataacatctatagaatttacatctttggactctcatgcctaaatttaatttcctattggtttattatttcatctccgcctgacttctgtgttttatatcccaaattaaatttcccacagatttccttaggtatattattactctataaaatggcaataatctgttcactatagccaacactattgcttaatcatctttgtaattattttatcatttctctattttttgttttgtaatacacatatttaggaaaggacaagtaaaccaaattcctaaattgacaaagtactacgtataaattaaacagaagttggtacagtcaagcatgaatctctgaataaagccaccaactttgagaagtgtttccaacaacctcaagtactttttttcttcactccactctttataaaacttggtgataaaggtgttcacgatggaactaaaagttatttggattaaaatattgctggtctgggattcatgcttccccaagcaatattgatttgctaggggatttttttctgttcttattcagtctttttaatttaaaatattttatatttatgttgctttttttctgatgttttactgaattaattctatagtttccaggccacggcaactactgtaagggtatggcccatactgtcagattatattattcagtgttcctctgctcatctcagatccttcagaggctgctatttttacacgttctattacacatcaggacttttaggttttaattttaaagaagtgttccacatttgagccctctgatataccctgagttatagttacagttacagttacagtcagataacttctcagaaaaaatgactttgtagtttgaacatgttttctccatccctccatgttaattttttccagttcacaagtgaaaacaagattagtatgctctgaatctaccagtcagtatgtttcatcttccacctcaacattgaactgcttcctttcaccttatacatctttttaaacaatacattcaaggacttggaatataattggcaattttgttgatgatgaatgaggctgagcaatataatgatgccttttgctactctatagtgctttcagtaaaaagaaatggcttgaggactaagagtatatgaaatatgagtgagagaaaaagctctaaggtccttgataataaagcacctttaaaacgatatcatgagatgatgtttctccctaccaaaaaaaccccaaaaaactatgtgtgaaaaaaaaatcggctctcttgtatcaacatcgggcattcatgcaattaaaatcttttgtatgtgtctggtaatgatatctaatatttaacagagaaaggcaaaaactggttgagtataactgaattctaaacttgaagtcttttcttccctactggataccactgcagctctgcctcaatgtatgtcttaggatttaccacttaccttactccaacttttttcaagatctattaagacagtggtccccagcctttttggcaccaggcatgagttttctggaagacaatttttccacagactgggaggcaggggcgggggtatggtttcgagatgaaaccgttccacctcagatcatcaggcattagtttctcataaagaggtcacaacctagatccctcgcatacatagttcacaatagggcttgtgcacctacgataatctaatgccacgactgatctgacaggaggcagagctcaggcagtaatgttcacttgctcaccactcacctcctgctgttccagtccatggtccagaggttagggatccctctattaagacataggcttacatgcattcactgaacaatgctggctcctgaagaaagcttgggagttttgatagaagaggattttaaggtgttttcctaagatattctcacaacagttttggtaataggagctactgaaggaatatattcacttaaagatgctttcttcaaaacagtaactttcaaagatttatagtttatagcataatctagccaggcaatcaaccccatcaacactcaaccccatctgctctcaacaaactgaaatatacaaaataaatggactgctaaaaaatcgcttccaaatgtaatttaataaactgtaacaccagtggggctatctagaatttaaaaaaataacatggaacttctttatctgttattgtctattttttaaaaattatttatttatttatttatttctagatggagtcttgctatattgctcagcctggtctcaaactcctggactcaagtgatcttcctgcttcggcttcccaaagtgttgggactgcaggcataagctgctgtgccgtgccatctatttttttgtgtgtgattttttttttctttggagatggagtctcaactctgtcgccctggctgaagtgcaatggtgcgatctcggctcactgcaacctctgcctccagggttcaagtgattctcctgcctcagcctcctgagtagtggggattacaggcatctgccaccacaccagactaatttttgtatttttagtagagacggggttcaccatcttggacaggctggtcttgaactcctgacctcaggtgatttgcccacctcagcctcccaaagtgctaggattacaggtgtgagccaccacgcctggactgccatctatttttctttaaataagcatacctattgggatcatagctcagcttccagtgcttaatcatcaaaatcaaaacaaatgatcaagtatttattattatttttacatgtgagatatataatacatgctagggatgatgcaaagatgcataaggcacaagcgttgtcagagagtttacagctgaactgaggagacaagggatctgaaaattaacaaaatatttcaagagttaaacaagaaagaaaacttggggtcttagctgggacgttatagaggctcttgctatttctaggatctgcttaaaataaggttaaaaattaattattacttatataattttaaaggtagacatgtataactgttatatcacttcctagtcctgaccctggccttttcttagacttgtgatttcctaaaacttgggacaagatgttaaggaaaaatatgtaggcccgctcatcctcctttttttcccctcttgctcatggcaaagataatttttaaactaaaataaacacaaattgtgtaagtataacatttggatctcacatcagactcacacaaatctcagattcttatctagtaccaatctttattaatgactgaaagaattatagggaagtgctgggcacagatagaacattatttccctggggaacctgaaataatcacacatgcgtttccaaaacatccatgttatttcccattatgatgtgctttggtttcatattaacagatacgtttttaaaaatttacacagaaacattgaaaggaaatcatttcagtctcaaaagttttccattttataatctgtcaattacaaaaatagaaaaacgttcatgtagctatgccctattctccagccagccacgactcataaatccaaacattccaggtttatttacaataagctatctagccaggccaggtataccctactaaaatcattttatagatagggatttgcaggtatctttcctctagttaaccactattaacaagataaacaagaaggtctgggaggtcattaacatgtttatgaagtggtctattaaggtcatttattcccttcacatcccccagggaataagtcacagacctgctgttaataccctttattctctttagtttcctcttcgttgtcctctctctctctctctctctctctctctccatatatatatatatatatatgtgtgtgtgtctgtgtatgtatgtatgtgtacatatagatatatgagtaaaatgtacacaaattacttttaattggatgcataaagatatttccaccttgaacttttgctgtgcctgctcagcccctcctgctctatctaggattcattcttttctattatttgatttttttttttggcagaaaagttcttgtagtattgatataagtaagagcgagaaaaaacaattaatctagcctttatttgataaagcacttgtatttacatattaacacagggtgcctacatttttcggatagagatttttcttttctttcttcttttttttttattcctagagacagagtcttgctgtgttgcccaagctggagtgcagtggcacaaacacggttcactatagcctcaactttcggccccctgggctcaagcaatcctcctgcctcagcatcctgtgtgcctgggaccacaagcacatgccaccatgccaaggatttttttttttttttttttgtagagaccaggtatcattttgttgctcaggctggcttcgaactcctgggcttaagtgttccttctgctttgaccccccaaagtgctgggattacacgcttgagacactgtgcccagctatattcagacagagatttttcttaatcttcagaaaacataagccattatttatcttcaaaaacatattaattgcccagattgcttttgtaattttgagtcattatgagaaaaagtatgagaaatacttcttttgcaccatgtagttataatgataaaaaataaagactaaagaatatcactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaaggaaggaggggaagactgaatgggatttggagttttcccactgagaaaggggcattttctgcaaccaggtcagtgttcaaaggactaatgctctaaggaaattatcccaaagaagagagaggcagttcagggttattaagttattttaaaacattgcctgggctgttgctgctgacctttgtgaagggaacaggatgctgcttcccaggggaacagaataagaagcaattagagaagcctaggagaggcccgggaatgtttgggaattcacacataccccaaattacgtgggaacgctaagaatgaaaataaactaactttgattagggacatatttgggttctagaaaatattctaaaaatgcagctcacactggggctatatctctatgagtgttttcctaaaaacctgaacactcagtatctaatagaggtcaataagacttcaatccagtttcagaggagaaaaggaaagccaattaacatttcttaagcaatattccttatgtgtcataaagtagaatgggtgtcacgttaagcaaatggctcaaacgaacagagttgggatatgatacagttgtttcaaatgcagatttatttgatgtgactactggtttttttctaacacgtgattatgtaagaaagtgcatgtttaagaaagttagaaaaagaaaatggggaaatagctgaaataatttactcctcttcttttggataaaccaacttgaatatgttctatgctcattctcacatttccaaaagtgccacgaatgaggcagggaatgctataccatgtgtattataatacaggattattttccccatacacacattaaattttagctgccacatgtataggtgtatgtatatatgttgccacctttccacatgacatatgccatatagaatgttacaacatttttctgtaaaataaaaatgtatcattgatgacattctgttaagactcagtggctactatatcctggcccaaaaagtaggtcctgtccacaatgctcagtgaaaaacagtagttgatcaatttaaagctctattgaccactagaaaaccagaagaagcctcatgaatgatatttaggaaaaacagactctagttctactgaaacaaagctagagctgagagtggtcccaggcattatctagttcaaccttctcattgaggttgagctaagttatactccttatcatattgttagattaagatagaacggaatctagaactcatgttttggtatgtaccattcatacatccatgccaaggactgtcccttaagcaccaaactgtaggagctatgagaaactctatcaaacactcggcatgcttcctaacactaaagttcatgtctagagggcatgagagatggatttgagtggtaaatctaaattgacacacaaatactacaagattgttttgaaggtgaaatgagtcagcaaactgaaaagcacatagaattactgacatatgttcatgaattcattccaatatttaccaagtacctgttatctgtgaggcactatgctagaaaaagagataacaacagctatcctcctggagtctgttatttcagtcaaggtgatacaaatcagcttatgaaactacaaaaaaggatgtgagggtttttttcatgaacctatgagacacagatgatatcaacatctacatctcccaacaagatctataaaaccaaaaccagactcagcactctgcacaacactatggcacccctttcactctctttcagttaatatcttaacctgaattgttttcatgattatatcatcaataatgtattaccaactattccttcattgtggttccagagcttactgagactcaggtaacgtgacctttgaaaccatcaaatggcagaggagaaaacacagcagagaagattgacctctgggttatctttgtgtactaaagccttttgaaaagtcagagcatcaggcttttggcagtgatttcaaaaatttaattaccccgaatcattcaccagcatcctcaaagactgacagatcaaattagacagctgattctctgttgcatccacttcttatcatcaatagtgctaaatagttaagtgaaacatttaatattatttgtcctttctatcccgataagattgatggtgcaataagaatcctcaagggcaatatgaagattcattttcacttctctggaaaatgatcacaaacaatttctatttcgaagtcaacattcacaaaatcagaaaatgttagtactggaaatgacctatgatatcatgtcattctgcttccttaaatgacagagggagaaactgaggcccacagaaaataagcaatttcccattggtcaagtattaatagctaggtgacagtaaagctggaactagaattcaagtcttgcgatgcctagcctatttaaaatttcccctatttaatgttgtcttagctgctaaaaggtatattttgaagaaaaatatacataagaaggatcttaccagaaatagcacaaaattatatactacatgatgtgttcacattgtatgaaagattatgacaaaattcaactgattttcaaacccaatgtcagaagacttgtatcattcttagaagagtgaggtgtctggaataagaaatgaggaaatttttttttttttttttttttgaggcagagtcttgctctgtcacccaggctggagtgcagtggcgcgatctcgtccactgcatgctccgcttcccgggtttacgccattctcctgcctcagcctcccaagtagctgggactacaggcgcccgccaccacgcccagctaattttttgtatttttagtagagacggggtttcaccatgttagccaggatggtctccatctcctgacctcgtgatctgcctgcctcagcctcccaaagtgctgggattacaggcgtgagccaccgcacccggcctgaggaaatgttttctatgttgatatcatactccagtttctttataataagagcccatctcattgtcagaagacgtgtctactgcaaaccagccaacacagggatatttaacacgttgattgctgttaaggctaagatgtagttaggcactgctccctctgtatataaatacaggtactgaaatagcaatcaatattatgaaggaagaaatcaaccaaccaaaacttgaattggagcaatgcctggtaccaacaggggctagaacaagaatgagagcaagatatgctttaagcatgggacatatttggaatccgaaaaaattgccatgaaagtagtaatagaggcaatacagtagggggcaggggaaggtggtgtcaagattcagatgctactggagttaggggaacactggtactaaaaaccagaccaagatccgtgagttcaaaccagaatgtagaccaacaggatacagagagccacatataccaaaaggtaaatctagacagatggccacagttccaggcagagagtcaaatactcgtacaaatagagctataggaatggtaggccataagaagacaggacagtcagaacccaaatcagcaattttgtcagcacaaacagcaacagtaacaagaaatgttgactgaagcaactgttaacttcatccaataaggttttatatcgcattttgctaagcaggaagcagcagaaagttgtgagcaaaactcagatgcaataaatggttgtggaaacatgcctgagattgagagtgaagagaagggtcgatcaaggtcatcaggcaacatatacagcaatgtatatacaacattcaaaattaccagcaggaaaagataaacactcctttggacatgagttgcttcttgagcattgcatgtaaaaaaagctgagcagttagcaagttcccaagaaccccatctttcactcttctgtgaagggcttcagagatatttcgaaagggaacctgatgaaatgcattactgctgatggagtcagcaggtttactcctgagtttcattagtgaattcttcccaatatttagcaaccacagcgtctttgaaggaggaaaggaccagcttgtctaaaaatcaaatccttcctaagggacagctggcagaaatataaggtcaaacacttttgctggtattacagaaaagtagcagaaaaccaaccttcggctagaactaatatatgcagaagaggttatgacctcaattgatctctccatttctgcaccaatgggagacagcaaataacatttactttcttcatgagtgagtggaaactagagacaatgctaacaaatttcataaccaatatttgggccaccctagtcacgacatcccaaagaagatataacagagctggaaaagatccagggaaaaacaactaagataatcaaggggaaagcttatctttccgtcaaggacagactaaaagactaaaaaggattagaatttctcagactgggaagatgaaaatgaaaagcattagtaggggaatgtgaggctaaagtcgactctggataaatataaatgtttttactgaatttcaaagaatttaattaaggccattccttgaggttaaaggatgcagattcaagagaaattaaaatgcctatatttatatagaagtcggtacatttatggaacatattattattaagacaaagctgaagtggggaataggaaaagtttgacaccattggataaactcactgccagttgatttacaatgcattattaagaagtggtcatgatgtatccgaatttttaaggtaaaatgtactaggttacctgacaaaacaaccattggtatcttcatctgggacagagttccgggctagttgccctgttggtctgacccagtgtgatatttcttatgcttttattatgacatctatactggaacatcctgcatgcatgtttgggattcctaaattcttttgacagtccagaatacagaagaacaattttctaactcattaagaaagcaagagagtcccagctcttggctctgtttggtttacccatatgggagcatgcaacataaaaaggtgaaagaaatcctaacagaatgcagcagctggttaaaggctattatattgaaattttcatgagtttgacagtaggccaaaaaactacaaaatggcagagagtagaaaaggcagttgtaacaggttgaacattgttggtgattattttttcagtggcaatgaaagctgtaatcaaataacctgaaagagatgctggcaggaataagggagccccaagggagagggaatatgaaaactgtaacaatgatgtatgctgtggacaaataaactagacaaacacgtagtttgaagtatcaaaatcaaggttcttagcctcatatgaaaagctgatgtcaggatgcaggcataaacactgcctgatttgcaaactagagcaaaagatgttaatgacttaaaatctcaagaatgagtgcacaattcaacaaccaacaggaactgtgccactggtatagaaacctcttgttatgtgggcgatccctttatcccagcattgaaaagaaaaagttacaaagcattaaaaacatagccagagaagacacctggttttgcagctgggcatctgtggtaaaaactcttgactggaagtcaagacaaacaagataaaaaagaggaaaaatgaggactggttgaagcactgtcactgtaaacgtatttttgttctttttagaccaagacggcatctcagattatgaacggcattaagctgtgcataaagtccaccgaaccttgtacatcaaattaatttggtttccatagaacattttagataatagtaatggctaataagacacaagtgccattaatcatctgcttactgacaatgttcattttataaacatgtatgttttccctatattacagtttaacattttacactcatatttgagaaattataccatccctaatttcaaagagattataattgtagagagaattgctctccataaggtttcagagatatttttgagaaattacgtaatttcctcatttcaaggaactgattatttcagaggcttttaaggtctccatactcaccttttggcaaattttcctgcctattgttctctctctcttatcatgagccaggaagcataataatcctaaattatataccaagatttgagctctttaaagaggtgtgtggtgaaattggagtgggttgatagggcatatctaaagctaattaaacagtggaaaaataaaattcctgttttttaaagtaagaatttacattatgttcattaaaataatgaattttaaaaataaagatattatcgaacaaaagctgagatcttcggtttttaagtttggacaggacaactgaatgagtcatgctcattacgtcttagagctaaaaaggatcttagatatcatctagtccaactctttattttataaattagaaaccaaggtttggctgggcatggtggctcaagcctgtaatcccagcactttgggaggccgaggcgggtggatcacctgaggtcaggagttcgagacgagcctgaccaatatggtgaaacctcgtctctactaaaaatacaaaaattagccaagcatggtggcaggtgcctgtagtctcagctactcgggagctaagacgaaagaattgcttgaacccgggaggcaggggttgcagtgagccgagatcgggccactgcactccagcctgggcaacagagtgaaactccatctcaaaaaaaaaaaaaaaaaaaaaaaaaaagaaagaaaccaagatttttataggttaagtgacttgcctaaagccatacagtcgcctaatgacagagcctctaagactagactggaggactaaaattgaagttttcttattcatagatctgtgcccttatcaataccatcaccatggtctttaggtacatgaaggagcattggacaaataggatatgtagctgctctctaattccactgagaaacagcaagagactaatacacagaagggaattacagcttttctggaatttgtctctttattattttttggacggagttcatttccattccctcacagcaatgtactgggatctcttgtagtagaagtaacatcagggagaagatgaatatatagggaaaggacaatgggaccggggagaccctagcaatccatgtgagacctctagtgagccccaaacaagtagtcatttggagaataatagcttaaaggtgtcttgaattctccagtgatcctaaaacctcatctatgaaaggagaaaaagagtctttatttcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcataaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaagatggcaggcggaaaaaaatgggaaaacatctaatatttttagtcagactcatggcagaagcaagttcaaagacttcggttggtatcgaggactattttatgaacccagtaaattgtaattgttgttgaggtttccaattcaaagttaaatttaagttagactctagtgcacaatggatgagagactgtgaaggtatcgtaatcactcaatatcctctctcctctctcttccacgttgacccaatgtattgtcatttatatttcatgcaaaatactacagaaggtgcttccaagcactcgtattcttttgactggcacaaatgtttccagaaaacagtatctttctgttgttaggtgacaaatactgagtgttatgtatcaagaatgaacaactaagccctacgagtcgaggactgctgctttctgccttttggaaacatgtagtattcattcacccaaaacagttgtgtacatataactgcggaaatcttctatctttgacggaagaagaaatgtgagaaaacccctaaataaaagaaattgttctcgcaaagattgactcccactatcaataaaattatctggagcttttggttctattgtgaaaaatccgccccctctgtcacaaaacacaccatatatcctgcattaaataaacttttcttaaaagtcgttccccattgcatcagcaaatttacaatggtaattttagaataagttttttatccaagcttcctcaggaaaaaaaagacacaggtattgtaggccaggctaatgtcgcattttaaaaataaactcacttgtgaatatacaggttagtcacaataaatgctcttttaaaaatgtgatacttccaacttacttgatatagtagggcactttgtttggcgagatggctctctcccagggaccctggacagacgctgaaaagaagggaggaaaaaaagaaaggcaaggaggtcaaattcatcgcaaacaggaaagacaacattaatctccagaattacaattttacactgatattggtctgtttgctcagctgcccatgaagacaggatggattaacctgctgttctgaaatttctgtcctaatctaagcgaaactgaactcattcaggcacaaagataaatgcgaagaaaaaaaaaacccacaaacatttccactgctaaacctatagaacagataagaaactgaatgagtagactgacggggtttcttgtatgtgtctcccttgagtgcttttttttataatacttcctgttgctggttctcaatattttttactatttgactgactggattttattatttcagtagctgaaatatccctctgtgatatatttacattctaagttattgaagctaaagtaatatgcttatcactctgatatggttgtttttatctttattggtttaaagagaatccaaattcacttaccaaatagatgcttaatttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatatagagtaatagagggatcaaatcacccaacctttaaccagacatgctgttttgtaccttggagatatgtcatttaaacgatataggaaatggatttgtatttggccggtaattatgctttttcattttggcagacggaaatttttaatacagagaaaaaagacatttagctgctgttttgaagtagtctctgactttccatttctttctgtccttctttctctattcctttcttttcccttcctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtaccttcttcttaaaataccagcatcataaaaggaagaagagaactccagagagctcttggtccagccctcactggctgtgaatgccaagcctgtgaatacctaaactgagaaaagaatggctattctttccttaaaggtatctatgggctgaggcctcacaatttctcttattatacctttctagtttttttttttttttatcattctagtggtccagaaattctttctaatttggaggatgctagaccatcctctgatagcagaagaatcactttggatttcctacactattcttaggcgtctctcagaaagaagtgtgctggagagggctgctggctgcctggcctggcttaggggctttcggcctgaaagaaacaacctctaagcagcgagagacagaggaaaattggcgttgcctggctgagctaatgggaagacctacgtagggtatctagagttgactttttatgtttacattaaaaggggaaaattttcaattaaatgtcagagaagttatcagaatatgcttgaactaaatagctgaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttcttatctcagtgtaccagtggaagcttgtcattcttcataaagctagcctacgtaatagacacacacatcttttatgcctgatgtgtccatttttagtagcccatcaaaagcaaatttatcggcaaatagtttctatatgacaccgggttgtcctttggtattttcttatacagatgtgcttataaccactacgtgtaattccagggcagctttgtgattcagattcttgaatgtacaaatcaaccattatcatacggcaccagcatcatggggtattgtccactgaatttagatagcaaactacacatgcatttatttattgcaaaaccaacctctgaatttccttttgtgttacagacacagtatgttattaagagcaagaaagggtagcaattctatcttcaaatgcttttccttccttgaggtgacaggattcaatattgtgcccaaggtagttttgaaaatcacaagcacaggccacattatttaggggaagttgttatttcagccgtttttaaatgcatgatgaacagaatgttccaagtgatgcaccctggtgttaagtcatattttaatcaacataggggcctaaccagaaaattaaaaagaatgctaatgttattttaagacatgccaaaagagcactttctggaattccaacacaaataccttcattcatctctctacttttctcatacttggtggatttggagtttgataacataggtgggtcaaaaaagtggggacagtttagataaataaccgatacagcaatcactggaggtaaaatagaaaactcacctctggggttgaacaaaaggcattagggaggatctactagacttgttttgtcttttccagaatgtcatataaatacagtatgtaaccttttgatactggtttatttcactcagcataatgcataatccatattgctgtatcaacgatttgtttcttttcattgctaagtagtatgccattatatgggtgtactacagcttagttatccattcacctgttcaaagacattaggttgcttttagcatttggcaatcatgaataaagctggtatcaacatttgtgtacaggtgtttgcataagcataagttttcatttctctaagatgaatgcttaagagtgggcttgtagggttacaacagatttttcattgctaaaaaattcccacttatggatgtaccatgatttattgaataaattccctctttgggaacatataagttgtctccagtttttcactgttctaagtaaggccacagtgaacatctttgtagataaatctttgcacatattttagttacttttttaaagcaaaattcctagaagtatatttacttgattaaaggctatgaatgttttaaaaacattttacataaattacacttatggcagcagaagcctctctttattgatataagtgtaaagagaaaaatcaattttctgcaggtcaatagtatttagttggcataattctcaaagcaagttagatatactgcttgatacagtagattatttgggaacattcctctcacactctcctcttcccctgatagactgtaaaactcagagtttagaaaggcactcaggatgttggctttctatttcaaagcccaatccagcatcttgagagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaagaaggttcctaccattggtgacaatgtggatgggccttgcagacatgctcagtgaaataagccagtcatagaaggataaatgctgtatgactccacttttatgaagtgtctgaaatagtcaacctcatagaagcagtaaatagaaaagtggttgccagaagacagggcaggggaaacgagaaattgttattcaatgagtataaagtttcacttatgcaagatgagtaagttctagagatctgctgtacaacatagtgcctatagttaacaatactgtgtagtgcacttaaaacttaaggggattaagagggtccacctcggccgggcgcggtggctcacccctgtaatcccagcactttgggaggccaaggtgagcagatcacgaggtcaagagatcgagaccatcctggccgatgtggtgaaaccccatctctactaaaaatacaaaaattagctgggcgaggtggcgcgcacctatagtcccagctactcgggaggctgaggcaggagaatcgcttgaacctgggaggtggaggttgcagtcagctgagatcgtgccactgcactccagcctggcgacagagcaagattccatctcaaaaaaaaaaaaaaaaaaaaaaaaaaaaaagagggtccatctcatgttgtgttcttgccatgcacagacacacacaaaagcaaagggacacaaaacttttgtaggtaatgaatatgttcgttatctttagtttgactgtggcaatagtatcttgggtgtatacatatgtccaaacttaccaaattacatatattaaatatgcatatttttgcatataattataccccaagaaagctataaaagtacaaaaaaaaaaaaagatgagtacagtggaggaaaacaaaagggaatgtaccctggcaaatgcccccaaatggcggtggcagtagaactgctgtcaaagaaaaataatacagaagctagaataaagtgggatgaaacacaagaacagcctagctggtgaagtataagcaattcttgagcctgacagactaagggtgtagaagaagaagatgtatttgatcccacgatcactggtgacctcaaaagggcaatttcacactagtgatcagaggctgaaggagggagtagacggaggggaagcaagcatttgagaagttgtgtataaaaagaggaaaacagaaatggaaaggggcaacatctgattgttggtcatccctctcttgtgctctgtaacccagcctattcagttcacttcattactgaatttgcttagggtttctttataacgttaaattatatgcaaaatgtatttctatcgttttcatttcctaaagtcataatcaggattataatacagtatttaagctttcatgtagttattagtgttgaatatatatgtatatatgtgtaatttttcccattccaatttttttctgtatgatttctattttcttttgatgtgacgcatatagttcctgtagcaagagtaagttttctgtcatttaaatgaaaggccaagttaaatttaacacttttcaaaacgttaaattaaaataaggatagtgctttatatgtctatatcgtatatcaaaagtaaagattcaatgaaaactttaagatcacttactaaactttcaaagatgggcagactttccataaagatttcaacagcagagacagatgggctacattccagagaggaaggtcacaagagtgatgaatgagacctctaatgtctgccatagctgtgaaaatctttatggctaactaaaattcctaacgaataacaacctgtaaatattatatgagctgtcagacagataatgctgagctctgagaccattgcacatggtgaacagaataccacaccatgggatttgtcagtagattgccaagtcatttagagtatcaggctcacatttgatctgggaagtcaagagttcatactaaaattcttggcaaggtgactgagttgcagagataaaactatatctaatatccagtgctgatggctgcacagtcacacaaagtctaatagccaaagttgggcggcattactcatgaaaaaaaaaaagaaaaaaaagctgcttctaaccgacttatagaaaacttcaaaaacatcacggtgattattagaagagtaagaaagcaatcaagcttcctaaggtcagatataggaagatagatacctacataaatagagccatgaataatttatgctcaaggaattttcgagtaaattcgaacataattggctgactgcattaccagggaactttcctccaggtaatggtggttacagtctttgggccatctgggttaagtcaggttactaacaagtcaatgcaatatcgccaggtgcctttactgtctctgcagatgtacttttaaaagacgacaggcagtccacaccatttgctgaacgctctctgtgtgaaaggtattgtattaggcaccagggaaatttcaaggaaagtaaaatttgaaacctgagacagtagggagcaactcagatattaaaaaccaaatgatcatagatgggatgtacatccattagaaagcgagaagagtgagaaagaactagcaattaacgcaaaaagagtataggagagattgaatttggggcccatttttcactcagttgtgaaagaactaaacatgtataccttagccatggcctcatggtgagcgcagtgtgcttcctagctccttgaccttggcttgcttgaccatgtgacttgctttagcagatatgatgtgaacagaggcttgtcacactggcaatctgccatgagaacatgccccaggttgcttctgatcctttagtctggggctcacaacccaacacatttagaaaccatctaaactgaactcacagcctagaggcgaacccaggcatgcttcagtatgaagtagagctttccagtcaagttttatccagatcacccgaattacagttgacctgtagacccataagcatgagaacagaagctttatattcttgtatagtagttatattgtggcattattgtggatacagctgacagagagaggagtagagagagaaggggagaggggaaacagtatcataaagattaaagaataaaaaatatcctccagccaaagtctctcccatttgttactagccactgcctctactaacatgcaaagattaatggggattatcatcctctttggtctgtgcagttgagacgtgtgggttgctattcactggtgtctggaaccccttttctaaggctgataatccataatagttacaagtatgaacttgaatatgttagtaaattgttctagtctcagttttctcttctgtgaaatggagacaataacagtccttattttaaaggttggtgtgaggattaaacgggttaatctatgcaaaatgcttcctctgtgttaagagcacagagcgctcgatactttttaaaaattccaactcctacgtttataattattttcatcattaatgtagctagttatcaggatatttatctcattcacgaacttactgccaatgtgaggaatcccagggtaaccaggaaagtgacagagactttccatggttctagagttaaactgactgttaaccaccaaagcatgggaccagggaactagttaaggaaataatctttcttcctctttttctagccattttctgactctttaaaaaatgttacgcggttctcagagtaataaaacatgaacggagacaaatcttcctcttggcattctgatgctgatgtttactatgaaaatcaactgtgttttatcattatatactatattagtattgcttcagaattcaaaataaatagctaaatatttttagaaataaataaaacattcttgtttaatttcaattgttggttctgatttttaaactaaatttttacataaccaagcttactattttttttcctatttaaattggtgtgggtgattcatgttaatggaattctctgacctgaagttatgtgctgtcttgtttaagacataagccttgctgcccccgccttttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgattttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggcggtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcccaaagtgctgggatcacaggcgtgagccaccgcgcccggcccgagatattcatcttatcagaatggctaagtagaagggagaaactgatttttcatcactgaatgcatcttgtgactcttgctaggtgagatcagggaccaagcaattataaacattctttgctaagttcctatcaaaaggaataccctctactttggatttgcatgtagcctcagggacaatatgcgttaatactcaactagatagaacatctcctttctctcactgtggaatggattcctcccttccattctactcccattgcacccactatttactaccactgtaggaggtcattttttataggtctgtcttttgtgattggtatttaaatgtcccaaggcaataattctctttttatcttcatatttcaggtgactcgtttttgttaataaatataggaatgaatgaatgaatactacaggcacagtaagtaacaatgctacaggcaccatgtcacttcttagctcagaattctatgacttcccttctcacaaagcatatatgccaaaggcttttaacgatagccaaccatagttgataagacccttcctcgtctggcccttggtcactcactgacctcctatcattcaccatctttcttccttggcttcagtcatactggcttccttgctattaatatttctcaaaccctctaagcatgctccatcttggatcctttacttttactgtttcctccacctggaacactttgtcccccaatatctgactggtgtacttcctcacatctctactgaaatgtcaccattcctgaccactccactaaaagggtccccttctcccatcctctagcccctttagcctgctttattctttgtttttaaatcaaacttatcatgacctgattgtccatcttctcttgttaaaatgtaagctccacaataaataaactttgttttatttactgccgtttccccagttcctagatcagagtttgatttacattggtcattcaacagacatttgttgagtaacaaagtgaatcaattcttaactgactgaagataaagtgaagttcattaactctttctggacattagactaagcaccaggctaagttctttcattttattagactgggaacaatcttttaagtgcccagttattcattcaatcaaggcatatcctgcatctaatatgcaagatgttgtgttagatgcaaaattatttttaataaaaaagtaatgcaggccctatgcccttaaagtgctcacactccaacatatttcctttcaagatctatgttactgaccatcttacgttctaactcttgcctgtcatgggcatgtatgctgctgagcttaaggtttaaggtaagagattcatgtaattttatgctgtccccaaagtccttacctattaatggagatcatgaggttggacaccttaaataataataatcactacttatcctgaacaaaataatcaacctcattatgaaagcaagagtaaatcaaattacccagtgactgtaatgggcctattataatacctttttcttagatgcttctaaatgcctgtcaatttcattgccccctcacagattggcttcctccaggaagccaactctaaggcaatgattagagagcaggatagacaactgtggaagggaagtgaaagaaacaggaatagaaatagggagaagtcaaggtgaatgcagacccagtgacagtctcattcaaccccatgggagctcttgagctagaatgttaatgttctcctgagttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacatcagacagacaatgtctggagacatttttggttgtcacagctaagggaggggagtgctactggcatgtagtgagtagaggccagagataatgcacaggacagcccccaataatttttgcccacagaggtgtgatcccaccatttctgttgcgcaaagctttgtattctaggacagatgacaaaatgctaccccaggccaaactcacaaatgccttcattttctgagtagtgtaaaaatacacttttcagagccagcattccactaattatctggccccaaatgccaatagtgcccaggtcaagaaagcctagtttacagtctggcctgtggcctgtgagatggcattacccttagatggataataaataactaatccaatcagatgctttgtcttggagagcttgaatgtaatacacagagataaacagagatgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccgtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacatagcacataacagagcagtacctgcagtcgcctgaaatcaagatgatttttactgcagatatctgaaagtctatttaaaaatctagaatggtttttaaaccaggaacagtttatgtaagtctactaaagaacaaaatgccttttgtcctcacttcaaagttctcaccagaaagtactttgtaatcccaaactggttgtgttctgaaaatggaaaacatccaaatggaaaaacgaaagtaatgattcttgcccacagggatgtgatcccactatttctgttgtgcaaagctttgtattttggacagatgacaaaatgctaccccaggccaaattcacaaatgccttcattttctgggtagtgtaaaaatacacccttcagagccagcattccaccaaaatagtgcccatgttataaaactgattcagaactctggtgctggtctcttggccctagctcctcatgaggcccagaagaatctgtcacaatgaggaagatgaaataagaaagaaacagacatttgtctcatctcttccatgccaccgggctaatttccatgtaagtccgtgacgaaggagtggtggttagtgatccagctaaatgcgcccattcagctctaaagccagattatgcatggggtatgatagcagcttcataaagtctaggagaggttaatactattgttgttccactcagatcccttttactgagctggttcacccagccgcagttgttgtgagtgttggttgctaaggcctcattggtcctttcaccagaaatcctcccttggccaaatgggaactgctttgctatctcctactccccagaaatccacagccaatgactaattcacacgggaaaataaaagcccagccctggctgggcgcggtggctcacgcctgtaatcccagcacttttggagaccgaggcaggcggatcaggagatcaggagttcgagaccagcctggccaacctagtgaaaccccgtctctagtaaaaatacaaaaaaaaaaaaaaaaaaaaaaatccaggcgcggtagtcccagctactcgggaggctgaggcaggagaatagcttgaacctgggaggcggaggttgcagtgagccaagatcacgccattgcactccagtttgggtgacagaacaagactccatctcaaaacaaacaaacaaaaagcccaggccccttatctcaaagtagggacaatttgttctccagagctccctgtgggatcaagctgaagtgagtctcttccttcccacttaactccttgaccagcatccttcttactttatcctgcttccctcactccctttcacctgaacaaattacttctacaagaagccccatctatctaaatagggctctacttctagggattttacctaaggctagggtgagcaactatcttggtttgcctgggactacagagatttcctggaaaatgggaattccagtgctaaatccgggaaagtcccagacaaaccaggatgagtggtcactctgcaacgcacataaatatttggatcctgagcatccttcctgctaagtttatgaagattctttgcctacagggacttgagtgatccaaataacatagataaattagtcatttctgggaaaccatctatgcacaaaaaaaaaaaaaaaaaaaaaacaaagtgccccaatttgtagtatttgccaatttccatggagtaaatcttcccactatgcctgatttcaagctaccaaaggtaggcttaataactagctcacaattcctgtatattttacaattggctctcttgagccattgtaagccagccccagcacagaaattcccatagcagaaacaaaaacgttctgtttcctcatgtgttcaaattgatgggatatatagggccaacgatgcaaaatctggttgctaatgatactgtaaagcaaataaatctgagagcttattggggagtatacatttgagctaaaggagaaaagggccatgacaacacattttaagaagagaatataattattactgctgtagctgctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatctttttgattatttatcactcgttagttatacaaacaactattgagccgttctaatgtgcaaaacactggactttcagattagatccttggaaatcatcttcagaaaggagaggaactacttatactgaccattaaatgcaagagaatgaatgaaactttcatgactagtttgactctaacaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccatggcataaagtttagtgtgaaattaactggtgtgcctgaaaaaggcttccacagtcacctaaaactggagaactatagactccttatcctcttagagtctcagtgtataataaaaattccaagaattctaacaagaaataaacttgcttatctttgaaacctagtgtttttccaatcttattaatcagtactatttttttcaagggacagttatcaaaacctaatataacattaatgttttaaagaacctggcttggaaaatattcttttaagggacctctggaacttgtaaaatattaagaaaaccatggattctttttactgttatagaatgatttctccctttacccaaatatatagtgatctttcttggtgagaaaagtagaatttagaacagaagaccagagaattgaaataatggtcaggaaaaatctttaaattctttttttgagacagagtctctctctatcacccaggctggactgcagtggcatgatctcagctcactgcaacctccacctccagggttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagagactgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaatgcttttctcttctcattttctcttagatctaagataaaagaaaaaatttctttaacatgtagagattgggccaccaggaagaaacagtgaattcttttttttagtaaaaggctgcctctgtcttctgataaacaacagacagctggtaatgtaatttccaaataatttccaaaggggagtgtgtgtgtgtgtgtgtgtgtgtgtgtgtgtgtgtgagagagagagagagagagagtgcacacacgtgcgagacagagagagagagagaataagataaacagagacagtaagcatgtttacgctggcgggtgcaattagtagttcctccttatttttcttttctttgtaatttctaagctttaggagccaccctattattatttatagtaacctgaaagcacattactaaacatgtatcaactcaggcctgtctaaaaaaaagtatcaattcaaattcatttaatatgaccttagaggaatatttaaaacatatttttattcattggtggggggaagctgcttttatagtagcaaatacgtgacttcagagatgtcctgcttcaaatatggtgattttttttttttttttaaatttagggtcagggtcttgctctgtcacacagattggagtgcgggggggggtggattatggatcactgcagccttgacctcttgggctcaagtgatcctcctgcctcagtttcccaaagaattgggattataggcatgagccacaccatgcctagctcaaatacggtttggatggcacacccaatttctggtgcaattttctagaggtaagtttggcaatacacttgaaaaggcttacgaatgtaaacattctttaacatgacaattccacctttaggcatttatcctgtagaaagaatctgagatatttgtaaaggtataaaaaggatattagccataatgctcgatataataaagattgtgaaataatctttatattgagcaatttagaattgtgttggtaaatttggtacagccacagaagagagtattagccagtcattagaaaaattactctgaagaagaatatttaaacacacgaaaatattggaaagatagttttaagggaaaaaagcagctcataaaactgtagcatgtttttatctgcgcatggtttaaaagaaaagagagaggccgggcgtggtggctcatgcctgtaatctcaacactttgggaggcctcagtgggtggattacttgaggccacaagttcgagaccagcctggccaacatagtgaaaccccgtctctactaaaaatacaaaaaattagccaagcgtggtggcgtattcctgtaatcccagctactcgggaggctgagtcatgagaatcgctagaacccaggacgggggaggttgcagtgagctgagattgcactctgtctcaaaaaacaaaaaaataaaaaaataaaagatagaaccttgatacacacacacacacacacacgcaaccacaagagaaatacagaaagtatataaaccaaatttctgatagtgattatctctgagtcataggattatggatactttttcttttcttgtttgtactgtgggctttccaaatttttcttgatgtgtatagagtacctttgtaattttaaaaagtacaatgtaaagaaacaatccatccttagtctcaccgtcctatttcttaaatatcccttaaaccaagttggtattttctttatacctgcaagcaaagcttttaagcgtatattgatattccacatgggcatccaagagactgatgacttccggggctggctccattcaggcaggtagatcagtctctttatgaatacctgtgtctaacaggcctgacctttctggaagtgggcactgatgtgatatggtttgaaaggtgtgagaatgctccccttggcccctcaaagttccttcctcacagctcagagcttatggccgatgttctaccacctcaggcttatggattttcacactaataaaatgcaaataacccaggagaagtacacattaaactttacctatcacttgggttaaatgagtatatcattttctgaaaataggttttaatgggtaagacatgggaattcagagggggagtcagggagaagaaaatatgaatgaatatacctggtgtctgaggagtaattaatattcataatagtactattttttatttatggtttatgagtcgcttaggagtatgttatcacatttaatctcaattaaatcgaatagaatggctgtcaccaaggcaagttaagtagaccagagatttggaaagatgcagaagacgaaatctgtagcctttatcatttttctagagccgttcctaaaagccacgatcccactcatttagataaactgctttaacttatccctttttcttggcaactccaaagcattgtgaaactgtgtccaaataactagaccacatgcggataataaagttagagccagtccagaaaataagatacttcttcttaatctattatcgatgtatgacaaaaacacaggaccaacaccttccaggaaattttgttcaaaaagacaacagccaactggagacacacatgacaacatctactcaaatactttaaagtatttgtgagcgtggatctttttattaacccgtggagaatggaaaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctaggcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaacataattaataaaatagcaaaaccagtaaataaaaagaatggctagaggtcaagaacaaaaggagaatacaaggctcacgaatgtaatcctagcactttgggaggccaaggcgagtggatcacttgaggtcaggagctcgagaccagcctgaccaatgtggtgaagcctcgtctctactaaaaaaatacaaaaattatctgggcctggtggtgtacacctgtagtcccagctactcgggaggctgaggcaggagaatagtttgaacccgggaggcggaggttgcagtgagccaagatcacgccactgcactcacagcctgggtgacagaatgaggctccctctcaaaaaaaaaaaaaaaaaaaaaaaaaaaaaaaaaaaggaaggatgcaaacagttagggaaaggaaatgcccataggctgaggtttcaacttggaggcatagtatttatttattattgatatataatattttacatatttatgaggtaatgtgatattttactggcatagaatgcataatgatcaagtcagggtatttgaggcatccattactttgagtatttgtcatttgtctatgtattgggaacaattcaagccctttcttcttggtactttgaaatatacaacacatcgttgttaactacagtcactctattctgctgtcaaatgatataacgtagtccttctatctaactggatgtttgtacccattaaccaccctctctttatctccccctctacccacacacctttcccagccactagtatctatcattctattctatgtttattatcaatttttttagctcccacaagagtaagaacatgcgatttttgtctttctgtgccagggttatttcacttaacataatgacctccagttccatccatgttgctgtgaatgacatggtttcattcttgcagtgtttcattgtgtacagataccacatattctttatccattcatctgttgatatacacttaggttgatttcacatctttgctgttttaaacagtgctgtgataagcatgcaagtgcaggtacccttttgatatactgatttcttagctttgggatggataaccagtagtgggattgccagatggtaaggtagttctatttacagtttgttgagaatcttcatactgttactaatttactgttacattttcatcaacactgtaaaagagttccctttcttcacattctcaccagaatctgttattttttgtcttttgaataatagccattctaattggggtaagacgatatatcatgtggtcttgatttgcatttccctggtgattagtgatgttgagcattttttcatatacctgttggccatttgtatgccttcttttgagaattgtcactcatttcataaggcagggatcatttaatgaattatttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatccaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctcattctatataatgaggaacaattaaaacaatgtatcctttctgataagatactttgagtctccaagactgagaacactaaagcaacatttcataactctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtctgtgagggtgttttgcagacaagattagcatttggttcagtggattcagtagattgccctccccaatgtgggcgggcatcatcctgtcagttgaggtcctaaacagaacaaaaaggcatgttccttttttccctgcaggcctgcttgagctgggatgtcagtcttctcctgcacttgcactgggatttacatcatcaactcccctggttctcaggccttcagactgggactgaaatcacactaccaattttcctggctctctagcttgcagatagcaggtcatgggacttcttagtctccaactgcatgagataatacttaattttatatattcacacacacatagacatacatatatacacacacacacacacacacatatacatacatacatacatatgtatattgttgcttctatttctctggagaaccttgactaatcaatgtccctgggtaaattattcttaactttccttatcagtaaaatgtggaaaataatataacttatagggttttgtgggaattaaataagatgatacaatgtaaagcatttagcctagtttctgtcacgtggtaattgctcaataaatgttaccagctactgttcttgctactattatggttaataaaaggagaggaataggccaggcatggtgactcacacctgtaatcccagcactttgggaggccgaggcaggcggatcacttgaggtcaggagttcgagaccggtctggccaacatgatgaaacgcagtctctactaaaaatacaaaaattagcttggtgtggtggtgggcatctgtaatcccagctactcgggaagctgagacaggagaatcacttgaatctgagaggtggaggttgcagtgcgccgagatcgtgtcactacactccagcctaggtaacagaacaagactccatctcaaaaaaaaaaaaaaaaaaagcaaaaaaggagagcaatagactataatgtgcagggcaccacatacaatacaaaaatggctaatgtttattaagcaatatgtggcatgacaatatgaattatgttatttcatcttcacagtaactctgcaataggagttaatattattccccccgacttcattgacataaaaactgaggcatgagaggttaaaaaaaaaaaacttgcctaagcttcagtagttagtaaattggcagagctaggattcaaactcattcagtctgggtcttgctcttaactgctatcctgaagattaaagttgaaaaaaagtattttataaatatttaataagtaattggctttttaatttctttaatcagtttattgaatgcagaccaattctagtgtgcatatcgatgaaactgcagttgttcaacgtattttatggcccaatgcaaggtcaattcctggtcttgaagaatgtgataccataagattatagagaaaggttgtgggaaaacgcgtgcaaataaatgttgggcatatgtcattatttctaaatttagaatgggtcatttcatgaataaatcaatctagagataaatgtgagtgtttgggggtagagaggagaagatgaagatgccatatgggagtggacactgatcagaaatctttgcacatactgagaaagaaatcccaaggggaagatgtagatggtaaaggattatgactgtgccataggccactttctctagtaagaatgttagtttcatagggactgagccgatgcagcatcaaagttcattctagactcccaatcttctctctgaagaattttgccttcttatacaaggagcgctccagtggtagtttccagtgtacattcaatattgtcaagattttaaaatgagatcaaagtgaatttccatcttcataactcaaacttaagagaaggtatgacagcgagaagaattaagcataaaatatttctttccacaaattatcactggagaaaggttttgtgtggattgaatgcacaactggctaaataaagaaacaaatttatgaatgagaaaaacttgaaagcaaccaaagtcctcgaaagctttagcttgggacttaggaacaaagcactttattctttgagcaattatgcaaggaaatgaaatttgataatctattaaacgagagcctccatgcattagatctttctaactggctgtatgttaaatcaatataccgtggtatatacaaaacaggaagcaaaagccagaaatgatatacctgtgtcttatgttctggcacaatcagttctttccttggtggtttattcattttataagtatttgttaatattgaaagagataggcaaaaaacaaatgctatagtccctgatctctgcaagtgtaaaggtttggaggtaagaagtagtgacaagctgaagaaaggcttggggctgcagaacagtggtgttgaggacgacagtgagatacaattagttagtcatgttgaaagccgatgatgcaaagcaaggcgtcccagactctgaggctcaagatttaccctgcaggcaaagagaaccactgaaaatttctgtgacatgactcactattttagaggaaagttagggtttgggaagatcagtatagtgtaaaacagattcgaaagggcacctgagactgagatcagaaagaggctgttgtaacttactagacttgggttgatatgcattagaattaaggctgtattgtattcaatgtaaaagaaggtacatatgagaaggtattttgaaaggaggaagaactatccaatttggtgttggagattaatatctgaagaagcaaataaactcttggatttcgagtaaggaagactgggagaatgaagatattgctggtggcaatatgaaaatcagaaaaggaagaaatagcatatgtatgtatgaattcatttggaacataatgaatttgtcctaacagtgaaacatttaactggagatgtcatgtatagccagttagagatgaacaatttgtctcagcaattaaagaaaggaaagggaagtgagactaaaaggggtaagagtgagctttggaaggtgagccaagaaagaagagataaaggagtttaaatagaatgatttaaacagccaggaggaacccaatctcttctgaattaatagggcatgtctctgtttccttttataaaagtaatacaaatataacatctttttggaagcatacatcctgtttcaactattagatcatagatcacgaaagcttagaactggaagaaaccttgattgatacacgagggtctattcttcagaactatcccagatgggcagaaaactgccatctggtccatgagaactcataatctaggttgcagcaattcttcagtaaaagcatctcaggaaaaaaaggtccttttttatatgttccatgaggacagggacacatctttccctgctaaatcctcagtgagtagcacagtacctggcatataataggtgctaaattaatattagttgaatgaattaatgtactgtttattcacggatctttactattaacaactatattttgaatgaatcatttctttttcaagatccctgacacaagcttttgaaaaacttccctccctcccttcttcctttccttcttttcttccttcctccttttcttcctttcttccatttttgatgatgaaagtaaaaaaaagaaaagaagaaaaccatttagattcaattttgcctataatactagatttaaaaatgtaaaacggcaatttataaaacaaccctgaagtccaaatctcctccacatttgttttactctagtttttaaataatcatatttaagatttgagagttatgagggctatatattattctccttggtcttctcatttcagatgagttctgtagacagtatactgtttgcagagaccttcctttcttagcttcagtaagaaatatcactacattcattcaaaagatattgactagaatgtaagtttattgtccacaaagacagagatcttatctgtcttgttaagaatttatcacaatgcctagtacatagaagatgatcaagaaatactgaatggatgaatgaatgaaaggctttttgagttcctcttatttgtcaggcactgagataagtatgaatacggtagacttgaaagcgtaattctgggtataatgaatgagcaccaaatcatccaactaaattacgatacgacacacactcttaattccaagctgtgactgtttcccaaagctcagtccattcctctgtgtattgtgaaagataagctttatttcattttttcttcaacattgcttttaaataagccaaaagaataaaagaaagaaagaaaaaggaccgataacaacatcatggctcttagaaattatttcaaataaatttatctaaatgtaaatgttggttctttaactttgttttagattctcaagggcttccactttgtcttttgacctttctgttaattactctactttgagttttatcttcactagaagtttaggagagacaggcattacctccccatgtggaaatacactgctaggcaatgtggtttcttcctagtgtccaagctacatcttactgattactacatacataaatcatgtttactccagtctagagaaaatatgtaactaggaacgtatgttttgattttctggttctcagtttgtctagaccctagataaatatccatgggaatgcaagaaacagacatgacacttacacaaatgagcctattaaaacaaaaacaaaagcaaaagacagaaactcttgtgctgtgatgctagtaaataaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataataaaaaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatggcactcactctgagtaggagcataattcttaatagattttgtgtgacttatggcattgatactaatgccgtgccatctgagaccatccttaatctaccttttaaggttcctgcatcacagctttttttccttccattttatatttctgtgctgacttctttcttaatctgactcctttttttattccctcctttttctgtcctttctcctccagccctccccctttattatgttctatacaacctaccagaagagtacacagactctgctgaggcaaacagtgcctcaaatgaaggggctgtgcatgcttgcaagacaagcgaggcaggatatgaataggactcctagcctagtgccagcccaacgcttctccaagaacattcttcctctaattctgatgaactctgccatcaaactggaaggcaagagagaacaaaacagcaagctctttgtccgttgttaagcctttaatctttcacctcaccgatttctaaaatgcactttggatgtttgtttattggttttcttgcttatgcaactgcctcattctgtgataatggagtcaggttatatcaacattaaattgacttcatagacccaagtaccttaagggtatcattcattttaatttagaaaagcagcaatcaacctcctatcctgtttcatttgtcaaaatctttagttttaattacatctacagacttatgaaaattgtgacaggaagagaagagatcataggaagcatttcttctgcctttttttttttttttttttttggtctcagagagaaaagaggaaagttgaattactttgcctggaaggtgatgtaacttgatacagattttatcttaaaaaataggttcccttttaaaagttttcctaatgtatctcatgatttgcaacaggaactaaagtcaagtggctctcaccttacaacatcattacattaaatcatttacattccagccttagctatttattcttgagctttatttataccacatttggaagatatcgttctcacagaaattttctgaggccattggagcattcctttctaggggcattttggcccataagtagcataatgttcacatggtaattacataattatgcctcctggtatttgaacacaggagtatttccaaggaacaaaagtggcaatttgaaataatcatcagtgagataccatagaactggtattgtccgaaaaaaaaaaaaaagacggcatatattaggaaattcatattaacgaatgactgaaacaggtagataaatgcaaaaagataaagcactggaaatcaaacattttcatctcagtggcagaagcttttatattttgggtaacaatatacttgtagattttcagtttgttctactaaacacttctttaataaaggctggaagggggaatttgctgaagtctgcaacaacccttaaccgaggaaatcaaccctccttaaatcccgtaccatccttgcagcatttccaaagcttcctgaccttgactcccttcacagtcaatttgaccaccactcaaggaagcttgtccgccagaagaccctgtttccacttcccggctctcctcctctggcaagtgactgaaaagcgcctttcttttctctcactgatgcagaactgacaaaccagtatcaagccgttctttacaaatcaataaaccggaagatctcatctactgtacttccaaatcctacaacattctgtcttctctcttcttcgcatatcataagccacaagttatttacttcacgcttcttagtaaaggacaggggatggagcaatgtgcttccattgtttctctgtgtagatgtgtgagaaccagaattaaaactctgccatggactcacagtctctacggtctctctccctctgtcttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgggcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaaggattctttttctttctttaaaacaggttgttcccatattttccataagagagacatgtgtcggcttaaaagaaatgaaactacaatggtgtgagggaggaatctcctgattgttagcgtatattttctgcattttacctgaaattgtcaacgaagtgtaggtaaagttaaggcggggccctaggctgttcaataacgtggctaacatttggtttgagggccttctcagttctgttcccaaatagtcagcctttctttcccaactgcttgtccttagctgattagtaaataaccctaggaagataaatgattgttcataacaggcttccagtaccacagctgtgagtatttgcattttaagtgcaactttaaataattaagccattaattactcaaatacttattgagtgtttataaggcactttgctaggagaggaagcagaaaaaataaaaataaataagaaaacaaggggatggtctttagtgaatttgtagatttgatatttacaaataagcataataaagtattatgggaaagattttaatgtagtgcagtcattccccaatttgacagtgtatcacaactatttgagaacttttcaaaaaaatacagattcttagctcgtctaaataatttctgatttagttaatttgaggctgaggcttgagaatctttactttctttaagtctccacagatagttctgatgtacagcctggtatacatccatcagtgtagtggaaatgccacgaattttatgactcaggaagacctgagttggagtcccttactagctatttaaccagcatcttatctaacagcctgtgaaccttagtttctttatgtgttaatagaaataccacataacaacactaccaacaatgacagtaataatagcaaacatttatagagcatttactatatcccaagtgctatttcaagagcattataggtatatttcatttatgtctttcttatcagaaggtaaatttgatgagggcaggactcaatctattttattcattactgtacccccaggacccaggtcagtgcctgtctcatagtaggtacctaactaactacttgaaagaatgaacatcactatgaggaaagtacaccatagtgaccattttacagatgaggaaatggaggcacagagaatgagatgttgtaatgtgcacagttggagagaccactttctggcactcggtatgtactcatttttctgataactgcaaattgctagaacaagcctaaacagctatgggggttacagagtatctggatgaaattaatgaaggaggttgctttgaaactgggccttcacaattgggtaagcttttgatgggcaaaaacagaagaaacactctgggtgacaagagtagaatgagcaatttttttttttttggcactagtaaaggcccggatatgaaggataaacagaaaaagagttgaataatacaaggctagaaatgtagcttggagtcaaaccagagctgtacttgactgtcaggtttaagaatagagacttcatttagttgttcatgggaaggcattcaaatatttttttaataattattttaaaattgtatttctttcaaatgcattcacatgataataaaattcaagaaaaacaaaaaaagttatttaaaaatcaagtctctctttcaccatgtctctctagccattttcttccccattccctgatggcaagtatttccatactctacattaattttttaagtaagaaaaatattacgttggtgcaaatgtgatcgcagtttttgccattgaaggtaatggtaaaaccacaattacttatgtaccaacctaaatatcattgtcagaatggtgttttaggatgaatgaaagcatggagaaagcgaagagaggataagctgccagaaacgaaaacaagagatgttctgtgttaaatgtaacaatatcagaaagtagactcaaggaagcctcagactctcaccctaggtgaggaggagatggataaaaatcagaaggaaccactggtttgttgcagcatagtttgatgtaatagcaaatcagtaaatcatggacggttgaacaaagactggaggaatgatgggaaaattatgaaaggtgtggcagtgaattctccttaaagcccctcttatcattcattctcattgttagcaagatccctaccatagctggggcaaaaacaatgtatttaactaaaaatgagctaaggcgtgtaaagcgtttaacagcatctgttataaggtgagcactgagtaaatggtaactgttacttatttgtattaaaaggtggggctgggcatggtggtgcaagcctgtaatctctcacagtgacctgggaggctgaagtgggaggatcacttgaacccaggagttcaagaccagcctgggcaacatagtgagaccctgtctcttaaaaaaaaataacacaaacaaaaaacatggtgtcagagcagaatacaatggggtgagtttgacagacccatctttaggggaagttccatatctagcttcccttttttatagtaaatacttgagctggtttgttgagggtaacccatacgattttaatcatttaccaggacttaaatctggaaagtatgacagttgggttcaagaatcaatgattccaccagcattttcaagggctgctatgtacactgtactgtatgttcatcgtgtggtggatggcaaagatgggacatgaaaaatttcttttctcaagaaccttgtgtcttgctgggagatgactgcagctgagacgaattagagacttttgaactgatagtctctgtgttatgaccaataagggcaatatgtatttttggaagtgagacagcagtgaggccaggagcaatctgggaggcatcagaaaagaggtgacacagaacatcattgtcctaggtcagactcagtatcagcagcttagcatctcatgtccatgaggagtattttttgaacaggtattttgcatgccatttgtgatataatcttaatgattcagagattcctgagatttcaaacagtatcacttatagtgtcaatctttcctttattttagtaagcaacaagtcatcattctcttaccatcttttttttttttttttttttgagacgtcctgctctgttgcccagtctggagtgcagtggcatgatctcagctcattgcaacccctgcctcccaggttcaagcaattctcctgcctcagcctcccgagtacccgggattacaggcatgcgccaacccacccggctaatttttgtattttttagaagagatggggtttcaccctgttggccaggctggtctccatcctcctatcttttaaccatttcacggttgtttgcaaagaactttcaaaatacagtgattagaatgattcgttttcttgtcttttccttactgtattgaaattgattttttatggttaggtgaatatagatgattaaatataaaagcattgaatgattttgtgttgtttagataaaaactgtgaattttgcatgagtaaagggctagtatcgctattgttcctacttgaaaatgatttcagtgcactgatatcaaactttttctagacttttccaaagtaatcggaaatgctccaaattttgaaactttttgagtactgacatgacgtcacaagtggaaaatttcacacctgacctcatgtgacaggtcacagtcaaaacttttgtgtttcacgcacaaaagtatttaaaatattgtataaaatttccttcagggtatgtgtataaggtatatacgaaatataaatgaatttcatgtttaggcttgggtcccatcccaagatatctcatgaggaatatgcaaatattccaaaatccacaaaaataaaaaatccaaaacacttctggtcccaagcattttggataaggaatacttaacttgttttccgatctaacctggccctaacattcaactttgtaatatataatgaagaaataaaacaacagagtaaggccgggtgcggtggctcaggcctgtaatcccagcacttcgggaggccgaggctggtggatcacgaggtcaggagatcgagaccatcctggctaacacggtgaaaccccgtctctagtaaaaacacaaaaaaattaaattagccgggcatggtggcgggcacctgtagtcccagctgctcgggaggttgaggcaggagaatggcgtgaaccccggaggcggagcttgcagtgagccgagatcgtgccactgcactccagcctgggtgacagagtgagacaccgtctcaaaaaacaaaaacaaaaacaaacaaacaaacaacagagtaaacttccagagtaaacaaatctatacctcagggatatttaaatatcagaaataaactcatacttttgacttaccatcttcataaggcaatgcatatgctgaacacagatgattcttatctgttcaccaaactaaggtctttaaggactttaactactaagaatatttacgttaattcaagttaatatttgttttaaaaaacagaatcttttaaatattcaggatatagatgtttcaccaattcaatctaccctttctggtcaaaagttaaataaattggatggaatctcaagtattcataactacatataagaacaaaaactatcaagaatgtatcaacaaaaggtttccgtggcctctttcagtacacataagacatgtatctttttttttttttttttttttttttttgagacagagtcttgctctgtcaccaggctggagtgcagtggcgccatctcggctcactgcaacttccgcttcccgggttcaagcgattctcctgcctcggcctccccagtagctgggactacaggcatgcaccaccacgcctggctaatttttgtatttttagtagagatgagtttcaccatgttgcccaggatggtcttgatctcctgatctcgtgatccgcccacctcggcctcccaaagtactgggattacaggcgtgagccaccgtgcccggccaagacatgtatctttatagagcaaggtttctcaacttcagcattattgacattttggcctgggcaattttttgttgtgctatctatcccacgaattatagagaatgcctagcagcatccacaacttctacccactagatgccagtagcacctcctcaccagttgggacaactgaaaatgtctccagaaattgccatgtcccctgggggacagacttgctcttggttgagaaccactagtgtacagtaaactttcaccctctacttcatatacacagatattgatgtttgagataagagagtcctattctatgtctataactggttgaggaaggagaagttaacagtcccgagttatatacagactattgtcagatctgcccaattcagtattcctctaattggcagtctttgctctggcattccttgttgtgctgacacagagtctagaagatctgcattgtgatctgatggcttcccttgttcaattctgcttccacccctatttcttcacaggtgttattctgcaataaatctgccctggcatctgcttcttggaggactcaacctgcaacaataatcaatcaatcaattccacgattccattcccctagcctaggtgggcatgtgacccaatttgggccataaagagtcaagcccatacttgaccagtctttaagctctcgggtcagagtagctctctcttttctgcagggtatgttgagggtgttaagaggatggcaggtgggcctgcagcaatagtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggctgatccactctctctctctctcaaaaaaaaaaaaaaaaaaaaaaaaaacataaaaaaaaaaataaataaataaaaaagataaaagaaaaaaaagaaaaaaaacttaagtaggagggaaagtctagagttgacagagctgaaaggctctcaaaattttaagacttttttttttaagtgtcttaaaatattttagggactttaactttgtcttagtaaagatgataaaattaagttcactacacactcattctttttagaagcttttcacctcccttttaactgtgtgcatttaatttgtgtaataatcactgtatgtccccttcaatgtccttttgtatctttttttttagcattttagtctatttctgtctgtctgatttttttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattattattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagcatagccagccacaggggttagtgctttggcagcaattctctttttcccctcccaacttctgcacagtgtttattgagcttactcatatcatatagttcacagctttgatagaaaaacttcttgtttcctttttgtatttatacttagattttctacattgttttgaatctttccgacgttgtgtgaagttcagagcagcggaaaaggcaggggtgcactggagaggatgtgtcccactcagatccaatgcttgcccatatcagatgaaaaaggaatcaattctcaaccagtgggagcaggagcaggtatacacatgctctggctttccatatttcaggctgtagctacctatatccagatttgttttcttctgtacacttctcaacagttccagagaattgctcatctttctttgtcgcttcattcttcttgttctcttattcctgcttcttagaattacttgcacccaggtccccccgcccttttttttttgagacagagtcttgctctgtcgcccaggctggagtgcagtggtgcaatctcggctcagtgcagcctctgcctcccgggttcaagagattctcctgtctcagcctcccaagtagctgggattacaggtgtgtgccaccaagcccagctaatttttgtatttttagtagagacagggtttcaccatgttggccaggctggtctggaactcctgacctcaggtgatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctctttgtcatcaataaatgttcatggaaattcaggcactatcttaggtcccactgctgaggccgggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgttagatttaaagataaaagtagattcagaaataataccctaatttttgacttgggcaattgggtgaagcgtagcgttcataagaacagcacaattagggagggaaaaatgttgagggtggattgggacaaaaggaggataataatgagctgctggggacatgttaagtctgaggtgtctgtgggacattcaggttgtggtggacaagaaacatagaaggtggctgggtctgaagcccaggagagaaataagtctgaccttacttcaataatcaagccagccatttcaaataattatgctagagcaattgaacatccatatgcaaaaaataaacctcaacttaaacctcatactttatataaaaatcaaatggatcacagacttaaacataaaatgtaaaactataagacatataaaacaggagagccaaaatggtgaaaccccgtctctactaaaaatacaaaaaattagctgggtgtggtggtggaggcctgtagtcccagctactcgggaggctgaggcaggagaatggcgtgaacccgggaggcggaacttgcagtgagccaagatcgggccactgcactccaagctgggcgacagagcgaggctccgtctcaaaaaaaaaaaaaaaaaagaacaggagaaaatctttgggatccagggctaggcaaagtattcttagactcaacacaaaagcatgatccataaaaggaaaaagcgataaattcaacctcgccaaaattaaaattctttttcatcccctgttaagaagatgaaaagatgagagagaaaacatttgaaaaccctatacacaagaaaggactagtatctgatacagaaagaactctcaaaaccgaactataaaaaaacttttgaattagaaaatagacaaaagacatgaacagacatttcaatgaggaggatatacatatggcaaacaagtacaggaaaagttgttcaacagcatttgccacgagggaaacgtaaattaaaagcacaatgagatattcctacacacatatcagaatggctaaaaataaaaaataatgacaacaccaaatgttggtgaagatgcagagaaactggatcactcatacattgctggtggaatataaaatagtacagacgcttcggaaaagtttggcagttttaaaactaaacattcaactaccatatgacctaacaattgcactcttcagcatttatctcagggaaataaaaacttatgttcacacaaaaacctgtacattaatgttggtagctttattcacaatagtccaaaactacagataactcagatgtcttcaaggggtgagtgattaaataaactagggtatatccaaaccatagcatacaactcacgataaaaaggaaacaagtcttgctgcatataaaaagagaaatctctagggaattatgttgagtgagtcaagtccatcccaaaatattacatactgtatggttccattcatataacattattgaaataacaaaattaaagaaatggaaaacagactagtagttgctggaagtaggaggtagggggggcagggaagtgggtgtggctataaaaggccaataggagggatctttgtagtgatgaaaatgttctgtatactgacaatattgacgtcaaaatcctggttgtgacattgaactagagttttgcaggtgtaccattagaggaaactcggtaaaaaggtatgtggagtccgtgtataatttcttacaactccatgtgaatctacaattaaaaatgctgagatctagtagttctcagtaatgtatcaatgactgaattttcatcagattagttatattgaatattaattctaaggttctgtcactatcccttttcaagaatctagaagcttagatttctttttgaagcaatataccaatagttttcttattaaaaattcagaaggcttcaatggcgaataattttttggtaataagaaaaaaaactaagaattattttttattaaaaaacaacaaaatcagctcttaagacacttacagttcagatggggaaataagatctagatatgtgaaaatgagtagtgtccggtgaaaggctcgtttctgggtggttagttcaaaggttccctggaggacgctgagcttgagctggatctgcaatcacatctggattgagggaatccttccagcactcagcaaatagcaggaaaaactgtccagacacagcaggtatcaagatttggagactttcctcatcaggagggaagcatttgttttgtttgtttggacatacaaggagacagaaagaatattgataatggatgtatttgaacccgatcttggtgacaatgttgagccaaagttgtaaacatgatgattaagaactcaggtactgaagttggactgcctggtgtgactacctcgtttctcaactgagagccactgggcaaagcacttaactcgctaagtttctgcttttgtatctaaaaatgatactactcatcagaggtacctcagaaagtagttgttagaattaagggagataacgtatgtcaagtccttagcacagtgactggcagagtctcatctggcatatattagctctgagcttaatgggggtgctggtggtgataatgacgttgtctctccaaaggttgcaaacggcttaggggcagagactatcgcttatcttagactacctgatgtctgggacactcctggcacacagcaggagttttgcgaaattaaactggcaaaagtagtgttcttgcaagattaacttgacagcaattggctgaccagatggaggaaggagagattttaggcatagagtacaagtagaaagctgctgcaatgatacaacttcactcctcatgacaagggtcagaaaaaatggttggtgtcagcgggaatgataaggaataggtaagtaatgaaagatgaattgaaggacatagttcctgggctttgactccacattttaactatgaatagattctaagcttgactgtagtgtgcaaattaggcctctttcggagagaaggcccagtatagcagaaagaacatgagttttgaagttaaacactgttctgtcccatatgtcatttgtgtgaccttaaaaaatgtatttacaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcaaccccaaatctccttaagctgataagcaacttcagcaaagtctcaggatacaaaagcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacaggaagcaaaacagcatggtactggtaccaaaacagagacatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacgaaaattaattcaagatggattaaagacttaaatgttagacctaaaaccacaaaaactctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaaattttcgcaacctgctcatctgacaaagggctaatatccagaatctacaatgaactcaaacaaatgtacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtacgtttattgtggcactattcacaacagcaaagacttggaaccaacccaaatgtccaacaatgataggctggattaagaaaatgtggcacatacgcaccatggaatactatgcagccataaaaaatgatgagttcatgtcctttgtagggacatggatgaaattggaaatcatcattctcagtaaactatcacatggacaaaagaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacctgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactctgaaaggccaaacctactccagagcttccctgcatgctcctgctgcagccataattgcaactgcatggtgaaccagcttttcctctgcgcagtcatgcccctttcagtttcttagaggtgtaaatcctgagagcacttcccagtatgacaataatccttctgcaagcaactctccaactgcttctgcttctgagcctagtcttggagagccttttattcctaatctgtgaaagggaaaaaaggtacacagttgttattgagagttgtgctgggaataaaacgagatcatgtgcttggcagaaaaccgtgttcaagcaatgacagctaataggtgatacttgaggacattatgctacgtgaaataagccagtccaaaaaggaacaaatactgtataattccgcttacatgatgttcctagaatagtcaaatgcatagagacggaaagtagaaagatggctgccaggggctgggggaaaggaggaaatgagaagtggtttaatgggtacagtttcagatttgcaaggtgaaaaagttctgcaagtccactacatgacaacatgaatatacttaacattactgaactatactctaaaaaatggttaaaatggtaaattttacattatgtgtttttaccacaatttgaaaagaaagaaatgatggctaccataccattgattccatttaattgattttacccacaagcaggtaccttttctggcttctcctgtattttctcatcctgttgggtgggacctatagtttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggccagcatttaccacctctgatgccagtgcatggggaaaaacaaattgccccatttgcaaacttagtacatatatgcagttaggagttgctctactcgttacacaaaaagattttataagtaaaaaatacttaaagtctggcactaagtttctactccctgtttgttttgattttgatacctgtactctattctaaagacttggtagtgagagtagagcgggaggtggcggggggaattgaatgcctcccaagtatttgaagggctgtctttgccaagagggtttacacttactgtgtatatttccaaagcatacatatagacagaaaggcagaggttatgggaagatcaacttcagctcaatgcaagagataacagcctaattattagggtgtttgtgaactgaacaggctgctttacaaagtgaggagttccccatcactaagttttaagcctaggccaaagtgttttctagcagaaatgtggaagaactcctgaaaggatttagactagatcttgaaggcccctttcaacctaagattttattactcaaacttgttaagatgtgattaacactagcttaaataagttaactatcgagagtcagcctaatgtaatggttaggattaccaggtctgcagccatattacctgggtttgaatcttggcttcttactagctgtgggctttgggcaaattactcaatctctctataccttagtcttcttatttgtaaactgggaattacaacagtacctatctacaagatcgttgttgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcctttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggtaagcggcctctttttactctctcctccaacctctcactatccctcaacctctttctcctttcaatcttggcgccccacttcaatctctcccttctcttaacttcagttcctttccttttctggtagagacaggagatgcgttttatccgtggacccaaaactccggcaccggtcacggactcggaagagtcttcccttggtatttaatcacgcggggatgcctgcctgattattcacccacatttcagaggtgtctgaccacacggggacgcctgccttggtccttcacctttagcggcaagtaccgcttttctcgggggcaagaaccccccaacccttctctccatgtctctaccccttctccgcttttctgggggacaagaaccccccaccccttctctccgtgtctctactcccttttctctgggcttgcctccttcactatgggcaaccttccaccctccattcctcctttttctcccttagcctgtgctctcaagaacttaaaacctcttcaactcacacctgacctaaaacctaaatgccttattttcttctgcgatgccacttgaccccagtacaaacttgacagtagttccaaatagccagaaaacggcactttcaatttttccatcctacaagctctaaataattcttgtcataaaataggcaaacggtctgaggtgcctgatgtccaggcattcttttacacatctgcccctccccagtctctgttcccaatgcaactccttccaaatcttccttctttccctcccacctgtcccctcagtcccaaccccaagcatcgctcagtctttctaatcttccttttctacagacccatctgacctctcccctcctcgccaggcccaattattcctcagcctctgctcctccaccctataatccttttatcacctccgctcctcacacccggtccggcttacagtttccttccatgactagccctcccccacctgcccagcaatttcctcttaaaaaggtggctggagctaaaggcatagtcaaggttaatgctcctttttctttatcccaaatcagatagcgtttaggctctttttcatcaaataaaaaaacaagcccagttcatggctcgtttggcaacaaccctgagatgctttacagccctagaccctaaaaggtcaaaaggccgtcttattctcaatatatattttattacccaatctgctcccgacattaaactccaaaaattaaattccagccctcaaaccccacaagacttaattaacctcgccttcaaggtgtacaataataaagtagaggcagccaagtagcaatgtatttctgagttgcaattccttccctccactgtgagacaaaccccagccatatctccagcacagaagaactccaaatgcctgaactgcagctgcgaggggttcctccagaatggcctcccccaggagcttgctacaagtgccagaaatctggccactgggccaaggaatgcccgcagcccgggattcctcctaagccatgtcccatctgtggaggaccccactgaaaatcggactgttcaactcacctggcagccactcccagagcccctggaactctggcccaaggctctctgactccttcccagatcttctcggtttagtggctgaagactgacgctgcccgattgcctcagaagccccctagaccatcacagatgccgatcttcaggtaactctcacagtggagggtaagtccgtccccttcttaatcaatacggaggctacccactccacattaccttcttttcaagggcctgtttcccttacctccataactgttgtaggtattgacggccaggcttctaaacctcttaaaactcccaaactctggtgccaacttagacgatactcttttaagcactcctttttagttatccccacctgcccagttccctattaggccgagacactttaactaaatgatctgcttccctgactattcctaggctagagccacacctcattgccgccttttcccccagttcaaagcctccttcacatctccccttgtatctccccaccttaacccacaagcataagacacctctactccctccttagcgaccaatcatgcaccccttaccatcccattaaaacctaatcacccttactccgctcaatgccaacatcccatcccacagcacgctttaaaaggattacagtctgttatcactcgcctgctacagcatggccttttaaagcctataaactccccttacaattcccccattttacctgtcctaaaagcagacaaggtttacaggttagttcaggatctgcaccttatcaaccaaattgttttgcctatcaaccctgtggtgccaaacccatatactctcctgtcctcaatacctccctccacaacccattattctgttctggatctcaaacatgctttcttcactattcctttgcacccttcaccccagcctctcttcactttcacttggactgaccctgacacccatcaggctcagcaaattacctgggctgtactgcctcaaggcttcacagacagcccccattacttcagtcaagcccaaatttcttcctcacctgttacctatctcggcataattctcataaaaacacacgtgctctccctgctgatcatgtctgactaatctcccaaaccccaatcccttctagaaaacaacaagttttttcctcctaggcatggttagatactttcgactttagatacctggttttgccatcctaacaaaaccattatataaactcacaaaaggaaacctagctgaccccatagatcctaaatcctttccccactcctctttccattccttgaagacagctttagagactgctcccacccgagctctccctgactcatcccaacccttttcattacacaccgctgaagtgcagggctgtgcagtcaggattcttacataaggactgggatcacgtcctgtagcctttttatccaaacaacttgaccttactgttttgcctagccctcatgtctgcgtgcggcagccgccaccaccctaatacttttagaggccctcaaaatcacaaactatgctcaactcactctctacagttctcataacttccaaaatctattttcttcctcacacctgacgcatatgctttctgctccccggctccttcagctgtactcactctttgttgagtctcccacaattaccattgttcctggcccagacttcaatccggcctcccacattattcctgataccacgcctgacccccatgactgtatctctgatccaccagacattcaaccccatttccccatatttccttctttcctgttcctcaccctgatcacacttggtttattgatggcagttccaccaggcctaatggccacacaccagcaaaggcaggctatgctatagtacaagccactagcctgcctcttagaacttctcatttcctttccatcgtggaaatctatcctcaaagaaataacttctcagtgttccatctgctattctactactcctcagggattattcaggccccctcccttccccacacatcaagttcgaggatttgcccccgcccaggactggcaaattggctttactaaacatgccccgagtcaagaaactaaaatacctcttggtctaggtagacactttcactggataggtagaggcctttcccacagggaaacataattcctcggtttggccttcccacctctatacggtcctataacagactggactttattagtcaaatcacccaagcagtttctcaggctcttagtattcagtgaactaatggtcttttaaaaacacacctcaccaagctcagccaccaacttaaaaaggactggacaatacttttaccacttgcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctcctatcttctgtctagtcatactcctattcaccagtctcaactagtcataaatgccctgctcttgtttacactgctggtttacactgtttctccaagccatcacagctgatatctcttggtgctatccccaaaccaccactcttaactcttaaagtaaataatctttgctggcaaggctatgctgaacctccttaggcactctctaattagacgtcctaggtcctcccaattcttcgtcctttaatacctgtttttctccttctcttattccgtttagtttttcaattcatacaaaaccgtatccaggccatcaccaataattctacatgacaaatgtttcttctaacaaccccacaatatcaccccttaccacaaaatcttccttcagcttaatccctcccactctaggttcccacgccacccctgatccacctcgaagcagccctgagaaacatcacccattatctctccacaccaccccgaaaattttcgccgccccaacacttcaacactattttgttttatttttcttattaatataagaagacaggaatgtcaggcctctgagcccaagctaagccatcatatcccctgtgacctacacatatacatccagatggcctgaagtaactgaaaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcgcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgttttcctgctcaaatgttgccttttccaaaaccacccatagcccaccctgccctccatcctgtgcctgtaaaaatcccaggctcagccggcacagaggagaagcagctggatgttggaaactatggttgtgcattggagagaagtggcttgacttccgagggacagcctggcagcatagcttcagagaggagtctgattgcggacagctggactcgaggtgaagattaccttcctgctctgtccccttttcagctccttttcctgctgagagccactttcatcagcaataaaatcccccgcatttaccatctccaattagtttgtgtgacctcattcctcctggaaaatgggcaagatctgaggtgccacaagtgcgagtacagaaggctgtcacactgaccctccactgagctgttaacacttaagccatctgcagatggcaaagataaaagggccctgtaacactccttctggggattcaagggtcgcgggcaccctcctagacactgccatggggcccacacagagttttgttcctgctggcgcccaaaagcactcaccctggctcctgtacccactcacctgtgcttcctctcccatgaggggtggaactcagtgagactgagccagtggagtctgcccctgccagcaccgaagcggctatgcagtccagttcccgcccgcgaggggatcagggtaatatcctgcttcactactactactactactactactactactactactactactactactactactttagcttcatagatatcaattcttgctttttggttgtgattttgtactctgatgaccagagaagagaacagggacctgtggaatataaattcatggtgaagtacatgttatgttatcaattcttgaaaaaccctgaaatgtagactcatttcccccatgcaggtttgttgtttttgaggaaagaaatgacagctgtgaaacaagtctaaattgtgccctaatgtctgagtgtccaacagtatgctgctgttgaagcaatagcaaagcagagacaaaacctattgtttcctctccctgtataactgaaaccatggccggttgcccttttctgtccatgatgtggaaagctctgctctcatgacctcaaaaatgggcatgtttcaccattcactcagagaagatcctattacagaaaaacaatacccagctgcaatttaactcagagctgagaaaccctctacccaatgattatgggcccacttttgtgatctacctgtgaggcaaaaagaacattctttcaacgatgtgcgtaggatgtctgtattaggaaaactgataaatggaaacgtggaggacttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctccccacttctttcaggtctttcctcaaatgtcacctcctcagtggaaccttccctgatcaccttatataaaatgacaattccttccatgaacaactctctagcgtcttccttgctttatttatttcaacatgctgtcactatttaaaattgttatatgataattgtgtacttgtttatcatctttcttctttgtttttcggttttttttttttttgagatggaatcttgctcagtcacccaggctggagtgcagtggcacgatctcggctcactgcaatctccagctcccaggttcatgccattctcctgcctcagcctcccgagtagctgggactacaggtgcccaccaccaagcccggctaattttttttttgtatttttagtagagacggagtttcaccatgttagccaggacggtctcgatctcctgacctcgtgatccacccgccttggcctcccaaagtgctgagattacaggagtgagccaccacgcccggcctatcatctgtcttctttacaagaatgtaagctctcctgagggcaggggttttgtcttgtttgctgctttattatcaatacctaaaatggcgcctggcatataacagacccacaatagatattaattgaatgactaagtgaatatttaaactcctagctaaaaagtcttcagggtttcttaggtgtaatctggtttaacacaccaagttgagaatcacagaattattagataattaaagcgaaaaaagacattaagtttacctagctcaatacctcattttgaagacagaaaaagtgaaagtcaaaatggttaaatgaggccaggagcggtggctcatgcctgtaatcccagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagagctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgattagcttagtgagttttaaaaaatcatttctacacttctgtgccctacttcacacagttaggatgagggttaaatggaatagacacatctaaaggtgctttgtgaaatgtaaagaattatatacatgaaacctgatcttaggatattcaagaaaattgaccatagaaatgcatttctccaatatactttaagaatcctttgtttttctaccatctgtttagtttagtctgtatacatctaacttttattcccatgtccaacagaactgaagttagagtgtgagagattccttcttcagctaatggaataaatgatatagagctcagtggataaacatgtgcttgagtgccattctagagcaagccctcatgacagctgagccagagaaacatatttcagccacttccctatctcattgcttcatatctcagataatttagaagtatatgattttaaaaatcactgctttctgatcaagtatcaattaacatcctcagataatttgggagggtgtgggattcgtagccggattgtagcaaagttggaacttaaaatggaaaaaaaaaacaaaaagcccagaccgaaagccatccatcacttacacatttattcacatccttgaattctgagatgtcatattcttttgatttttgactgacttctcttctcctacctctgcttgacttctttttcttgaagtttatcaaggtttggtcctaggccatcttcccttccctctttacatgctaagtgatttccattctggatgctctaaattccattttgtatcaatatttttctcatttacgcttctagctcgggtctctcctttgagctataattgaatttgacttctgcacttggacatatcacacacatttcaaactgaacatgtctaaaactgaactgttgatcttttccaaatctgcttcctcctccatctttatcacctcagcaaacagtacaacaagttgatcaaacaaaaaaaacttgggagtcatcctcaatccctcatgcctgacatctaatccatcaccaagtcatacagattttgtctcgaaaatacatctcaaatctgttcatttctctctatttccattgccgccatcttactcccagtagtcattttctttcatcaagacaactgcaaatgcctcttacctggcctctttgcttctactcttgccacattcaatctctcatttatacagcaggtccatcagattgtatgatgttttgcaggtacatcagctcaggtgtactttcacaggtacgtcagattatattatttctctgcttacccataaaataaactctccagccttgtcctgtaccactcaccccctcagtcattagctcctagccatacttgcctccttttaggtcattgtcttgaaaatattattccattcccctccctgttcatatgactgacctaaccttcagattttagcttaaatatatccttttcagagaggccttcctagactatgaagaagttcccactattattcttccaaagtagcctattctttgtcttcataacatttctcactatttttctttttattttatttttatttttttgagacagagtcttgccctatcacccaggctggagcacagtgacgtgatctcggctcactgcaacctccgcctcttgggttccagcaattctccggcctcagcctcttaagtagctggaagtacagacagggtttcaccatgttggtcaggctggtcttgaactcctgacctcaagtgatccgcccgcctcggggtcccaaagtgctgggattacaggcatgagccactgcgcctggagcatttctcactatttttaataatatattaatgctaacatttttactggctatttgtctcactgtcttgcaaattccttggcacgtccaaaaatatttcttcctattttgtgccagacaatatgccgggtgtttggactatgaagatttataatgaaaggtccttgaactaaaaggctacacattggctgggtgcggtgactcacacctgtaatcccagcactttgggaggctgagatgggcggatcacgaggtctggagttcgagaccagcatgatcaacatggtgaaaccccatgtctcctaaaaatacaaaaattagctgggcgtggtggcacacacctgtaatcccagctactcaggaggctgaggcaggagaattgcttgaacctgggaggcggaggttgcagtgagccgagatcacgccactgcactccagcctgggggagagagtgaggctccatctcaaaaacaaaaaacaaaaagcaagcaaaaaaaacggccacacatttagtaggaaaaatcaagaaaaggtttataaatagagtggtagacactgttggttgcctcatcaacaaccattccactctcccttttttctctagtgattatctatttccacacacacaaaaaaaagtttaaaaagcactgatagtcaatttcttagtttcccttgcaggtagatgcagctacttgacctagttctggccaaagagatgttagggagacatgctgttgcttctgaaacatgacaagaactgccactcttcctttattttccattcacactgtcatgatgcaattcctggagtgtggcagccattttataaccatcgcgtgacaattccaaagaccaaagccaaaggctaaggatagcaaatgcaaagatggaaagacattggattctgaatgaaactgttgagctaataaaccaattttgggtatatctttctcttaaattcctattatgtgagaaaaataaacgatggttgcttacattttcattatatatccctttactagaagttaaagcctctataccgacacaaactgttcctgctgtgacaacaatatagccagcacaagtccccccaaaccacagatcccctgaccctggtgtcaagattgggtcttctaattctgcatctgggtactctaggaagctttgtggcttcccatttatatgactgaagcgcgaactgtgtctatatgtgtatgcacacatgcacactggagagaaaggacaaaagatcattccacaattgagacttgaaggctaaactgtaagatggctgtacgtaataaagctctaatcctctattaggctcctgaaatctaggttttatggtttagtaatgttttcattatttcaaagactcagaattctttctctctgaggcatcacaaaagcttccatagaaacagatagagaatgaatgtcacaccaagaataggaaataaagcaaagaaaaatttgcagtgaactagtcattaatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggacgcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagtcttcactttatgcatgttaaacactgttactgttagctaaattgctctttacaacaaggcttacaagatgatgatactatcaacattttgtatatgaggaaactgaagtcttaagataaatctagctagctatggcagagccagaacctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttgttagcaggatatctaatatccattcttgttccattgatagcatttgaaatttatttatcaaataatcacttcagtttttctaaactaccttaaaaatatttttaaaacctgaggataaagaggacacatttttaaactagtgcatttttctcttacaattaaatcgatattccagctgggtgcagtggctcgtgcctgtaatcccagcactttgggaggtcgaggtgggtggatcacctgaggtcaggagtttcggaacagcctggccaacatggtgaaactctgtctctactgaaaatacaaaaattagctgggtgtggtggcacgtgcctgtagtcccagctactcaggaggctgaggcaggagaattgcttgaacccgggagccagaggttgcagtgagctgagatcatgccattggactccagtctgggccacggagcgagactctgtctcaaaaaaaattttttaaagttgatattccatttatttttctccacttaaatacagattttttttatgatctcataaggatcacaatgaatagctaggccttagttttgcagctttagtttcattactatgagagagagagaagggtgagagagagagagagagagagagaccaagtgtggtgagaagacatatgttgtctttgtgggtccagtatttcatccttctactaactgcctggttgttgtttctgtttttgtttttcctttgaggaatcgctttccccatatttcttgtgactctagtagagctgccaatcatggtacctttttgccttcctcaattcccctaaagagttcaaagaccccataggttactcagactctgccactcaggaagctgacaaaggaagaaaataatacaaggttggaaagactttggagcttagtatttcaaagacaacacttaaaaagaagatgcatgtgttcctgcttttgagattttagaactcttatacttcatgtcctattctgagacctagttttcaaattacttcgttcatttctatgagtatcttttaaataaagagcccctaccccatcccctttgttttccctgacttgaattagccagagttagctgctggtgtttataactgaagaccggcagacactgccggttagctacttcaatacctgttgaaaaccacttctccctagccatctttttgttggtggctgtcatgtgacacagttctacacaatgatatacaagtagaagtctttcaaaaaaggtttctgggaaatttttggctttataaaaatgataagactcagatagtacaccctttttgccttctctttttcaccctgtgaaataatggtggctgctatattgcatgaggaaaagtcaataaaaaatatacagatgccagtcctgatactgttgggcccaaagcaccttatttccagacatcttaatattggagataaataaaactctatttatttaagccactgtagatagcttctgtgttttttgctgccattgcaattctaaccccagccaataaaatgggaatatgaaaaacaaacaaaaaatatgaatccttctaaacaatgaagaatttatggggttagggtttgggaggaacagaagatatagccagatgaatttaggcatatctctcaggaactgacctttgtcctttagctattactgttgattagtcttagatggcagtgaaccttgtagctgatgttaatgcaaaactggagaacattgcatcctggatataggtatattctgatactctgatacagggcccttagcttccaaagatgacaattttttttttttttttttgagacggagtctcgctctgtggcccaggctggagtgcagtggcgcgatctcggctcactgcaagctccgcctcccgggttcacgccattctcctgcctcagcctcctgagtagctgggactacaggcgcccgcaaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccaaagatgacaattatatgtgtgtacataaatatgtgtgcacttgtactgagtaaaatagagactgatctcacccatacgtcaattctacttagacaaaggaaatcccagggtttttttttttttttttttttttttgtctctccataatgtgctattaaaataaaatgctattttgtcagtgcctttttcttttgctttcaatcctggactgtaggcaagacatacagtctcctcagagattgagaaaggtcaataatagaaatgctgttttcctcctttcactaactgattaaataacgcatgggcatatgtatagctacacgtgtatttctaaggaaaatcattcaaaaactgcatgatttcctgaggtgacctccagggtgctgaaaatttagaaaacgtaacatctaatgcaatcaataaaatcaagaatctgtgttaggcattttgagagttttggagtgagtgacagtacagccaattgatatagtccccgtgaaaggcaggtaaggcatctttatgtggctctctattgatgagaaaagtcttcctaagagaataaactagatttagagtgtgtcttatgaaaactgttgtttcccccatgccttcccagttaactcatttgtataattttggggcttcagctttgatggggctcctttatttgcaacatttagattaagttaatgactgttttatcatagctaagagcactagaattaggaggtcaatggctattagcatttgattttcttgatgataccaaagagatgagtttgagggggaagaagtgtgggcttgattactcatgttttaatttcatctcagtagacaaatccaaaatgatgtctcagggatgactcagaattccagatgggatatgtgtacttttgccctttgtccagtcctttgcacactgggcatatccactgacaacacaactgtcagaggaacaagctttcaatttccagtttcaagagggaatgagatcaggcttgaatgatcatttatggtgactgaattgctttctccgacaaggaagcctcacttgttcgtggactttacggatggtgctctcaaaaattggccagttaatctctttatctgttgcatctttcctagattccattgtgtctttcgaaaatactgtaaaatttacaaatgtagcttaggcaaaatgcaaatgtgtttctgtcttaaaaagaggaaatagctatctgcaacgatatgggatggagagaaagcgaacaggaggaccgtttagaatcatgatgtaggaaacataatgcaaaattgtaaggctggtgtgggggtatggcaaggataactagtgagagatccccaacggagatgtgaaatttggagaaaagcataggaactgcacataatgcaaagtttccttctctcactttgagctcagtgaatctgggatttgttttatgaacaaagatagcaagttgctttatgatggcagtggttataacaaatgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgacagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaattctcctgtcttggcctctcaaagtgctaggattacaggcataagccactgtgcccagccaggaggaaggaattcagttaagaggctagatcagtgaattggagccacatcatatatattttttcttttttagagatgagatcttgctatgttgccaaggctggagggcagtggctattcacaggtacaaccacagtgcctacagcctcaaacttctgggttcaagagatcctcccacctcagcctcttcagtagttgggactataggtgtataccactgtgcctcactggagctgaaggaggatatttccctgatcccttcgtgggtgggaactggaggggagcaaactccactcactcgctggtccacccctcatggaagggggagcacaggtgagcaggtgcagcagctggggccagcatttttgagtgctggcaagagtgaacaccgtacgggccctgcagcagcctctaggggagggtgcccatgaggaagtgttacagcgcccttttagctttgccattcacagatggcttaagtgttaacagctcagtggagggtcagtgtgacagcctttttcacccacacgcatggcacccaagttcttgtccagcatccaggaggaatgaggtcacatgaacaaattgaagatggtaaatatgggggattttattgccaatgaaagtggctctcagtgggaaggggagctgaaaaggggatggagtgggaaggtaatcttcccctggagtctgaccatccacagctggactcctctccaaagctatgctgtcaaactgtccctctaaagtcaagccgcttctctttgatgtccaactgtagtttctgacatccatctgcttctcctccttctgccagctgagctctggggtttttataggcacaggttggggggtgggtggggggtaatggatggttttggaaaaggcacccttcaagagggaaaacagggatgtaagttctcactttgggccatggttccaggctttttggcttgagggtgggtcctcaatggggacctgccctcttctgcccagaatttccctgccttctgtcctttatcaaagccacatcttgacaggctatggatactgacctggagggagagaaagctgtagctatagaagatttttttaatataatggggtactaggattagatctgttgtttagcaagataactagccatagtgataaagatggataaaagtctggggacagggaggctaatcattagaaggccaaatcattaatagtcactgagaaaggactgagggaagggcagagtagttagagaggaatagctggatttgagtgtttttatttttagatataagagtcagcaaacagaatttagtgaccaaataaaaactgaagataatagagaggaagaagtaaatgtggccccaaattttctaaattgcaatgacatcattaataaagaaagtaaatgcaaggtgcaaaacaggtttgattgtgatatggtatgtaggaaacacaatcatttccattggttgggccatatctggaatattatcatcagttctggatagcttatattgaaagtgtgaaaggaaaataaatcttggggcctcaaaatcaccaaactaaagggaaaagtcaagctgggaactgcttagggcaaacctgtctcccattctattcaaagtcatccctctgctcactgagatagatgcttatctgattgcctcctttggaaaggcgaatcagatactcaaaagaatgcaaccatttatctctcacctacctgtgacctggaagcccctccttgcttcaagttgtcccacccttctggatggaacaaatgtacatcttacatatattggttgatgtctcatgtctccctaaatatatataaaaccaagctgtgccccaaacaccttgggcacatgtcgttagaacctcctgaggctgtttcatgggtgcatattctcaaccttggcaaaataaacttcctaaattaactgagaccagtctcagatatttgaagttcacaaaagggaccactgttaattcttgcagaggaagataaagacgaagatgaaagtcttgactgagggtaattatgaggaacaacagagggaacgaaaaaaatcaatataattgaatacttttacaaaagcagttatttagagtgtataccctgaactcaagttctgttacacagtgggatatataacagtgatgaaagagccaagcttttcttagcttttcgacttagcaggacaatgaaaacaatcaaaaacccaactagttcacatcagcttgaaacgaggatgcttagagaagatacgaaaattgacaacgagtattttacagatgtagagaagtgacgtttctctttggctccagtgggcaggaatagatcaatatatagagatttcaggaaagccaattttcatttattataaagactttgaaacaaccagaactgctccctgggaaaagggtgatttatcatcaatgactgtactcaaactgggtttgaatgaccaaactgacagggattttatagggtcgaatcctgccttaggaagaaaatgaatgattcttaaatccctttaaattctgagattgcatggcagaagcacgatgaagatcacactacctaaaaagagaggatctgatttcaggtcctagaagccttggttttattggcccttagtttccatatctatgatatgagtttagatgagttatttctaaggtttcctgttgctttaaaacattcaatgattttagagttgcttgatgtcgttagaaatattgaatgccagaatgtggaatatttatttaattggataagaaatagaaaaactttgttcaaaaattttaagaaacaatcactattaaagctgcacttagaggctatttatctgcaacaatgagtagacgtaaccatgtcagctaacatttattaaatcctatttcagctagtgagctaagcacctgatataaatgatctcatttaattctcataacaaccctgtaacataggtactattcacagtcagggaaaccaaaccttggagaggttaaaacatttgcccaaggttacacagtttctaagtggtagagaggattcataccctgacagctgtcaacaggaattaatgaaagttctctgtaaagggccagaaagtaaatatttctggctttgaggaacacataaatctccgttacatattcttctttgggtttcgtacaacttattaaaacaagtaaactgtttttagctcccctgctattaaaaaaaacccaggccccatgttgaatttgtactgagacctgtagtttgctgtcccctgctctgctctcttactacaacaccctactgcttccccaagactactatttactgaggacttcttatgggccagacactgcgctaaatgcttttcatgcaatatctctgtaatacaacgagcctctgggttggtttccattttatagatggaaaataggcttagagagtttcagcagcaactgaaacacaaatacaaggctagaaagtggcagagctgtgagctttgtgaatctggaaactgtgattttatccattgcagtagagaggctgagtagagtgaactgggactggggcagggagggactggaataagaaaactggtgtgtagagcatggcaacagcctagacaattatggtatggtttgaaaaacactgtagcttcataatcaactggatttgtcagtttattggatgtcaggcagggtggattaggggaaggtcactctaaggtctgagcttggcttacttagagaacagaaataaggaaatcaggtatagggctgctttgaggagataaacggatgggccgataaagcttatggtggcaagatcccttatagttttggctgcttcactaactagttgtgttatggcaggcaaaaaaattagcttctcttggcttcagtatcctaaagtacaaaacgagggtgttgaattagatggtcccttagtttacttctagtgataatgttccagttggtgaaaagcaaaggaaaattctaggaaactgccaaaagaaagagcctagaataggctttttgagggaacgatttctgaaaaagaattgaacagaagggtgctaaaaagtttattgtaattcttctgtcttactgctctcagcaaataaagatcaaacagggtatttgtgtttgcaaggtcaaagtaaactagtgtccattatcaaatggctgaatgactcttaactggctcagagaaagatcagaaaatgtataggagaaaactaatggaaagagtgattaacgtgatcgtttctggctccaaagaataaggaaacatgggaaatgaagaaatatgaagaagtatgaggcaagaaataaagataatataaatgaacaggtcactatgattatttgggttgcctatttagacaagaaaatagggcatcgataatctctcatgcctcctagtacaattggaaaagaaaactaatgctagtatcactaggaaaagacatagaagaattacttttagaatcatcaaaaaataagtttgaaagcttttgcaaaaagcacagaagtgaatgttttgaagcaaatgaaactaatgggaattataatgagacacatagcagttttataatcttgcctctcttgtaatgtgtcagagaacaagaaccctgctattttaacacgctttgtctatacggtgccaacactgaacttgacacgaagagaagaaagtcctttctgatgagagcatgtagtatctggatctgtttctagactatgtgattcattttaaagatttctaaggaaaggacacatctagatcatctatgacgttaaatccgctgttctgaaataatatcaataatacaaacaaattctaattttatgtatgtgaaaaaaactacttatataaactcatattcattcgagaaacaaatactccaagttggatatcaaggagtttcctttcagttatcctttgttcagtggatataaatgctgtgctccttaatactgggtacaaaaagaaaaataagtttattagaaatatacacatcaaatacacttctgaaaaaaatgagaagctattgaaatgaggtcaactaaacagaaatctatttgtagggtttaaaacaccatgaatgagatcatcttttgtgattccatctatccttgcatttctcaaattctattttgaaatcactgcctatgttcattgcctaaaatagcttttcctttgattcttagatgatcttatgaaaatgaaaatatatataaggctattttgcatagaaatgattagacatagataaatatttacaccaaacagtttagggagtggggactagttatttcagagattatacaatgaaaattttagactgatttaaacatattattttatatgccagtttaggatgatgaataagtaatgaatcactgaatttctccctcccttcctacccccagccttcttcacttctttcctcctttattccttcatttctttattgacatacatacgtagtgtgtacaccccccatcttctaaagtaaccccatgggaagaaacgctcaggtggttatattaaaaaaatcgagggtatgaaaatctcagggtcgtatgcccaaacaccaatgcgatataaaaattaaggtgcacatatatgatttttcaattttttcatttttatgtgtgaatgaatttggaagaaaaacctttcatacactccagactttctgtgttttgtagccacagccttcatttgcaactctgacatggcaagctgctgttttctagatttcatttgtgtgggcgcctgctgcacaccaatatatattttctctttacaaccatccaccatgtggatgcatttctttattagtcaatatatattctgtaggttacattctgcaaatttgaacatggacaaaatgcaatcaatataatccataacactgcacagatgtcttggagagattgcagaaatcattcaccaggaggctgaatgtcgaagaattataaaattgcatttagatggacaagtcagaaaacaggtttaaaaagtagtacatttttaaatttgtgatttcattatgaccatggaatgaggtaaaagcataactgtagtcagcaatttacacttaaatacagaaaatgcaaaagacactatgtacataggaggaaaggaggtatggatgtgagaagaaacaggagggagaagcctaatgaatgatcttcagatgaaaagaatcaatgaaaaatatccagctgtggttaaatgctttcaaattgccatttatgcaattgatgcatggaataggtatttgtcagtgcagagagtgcgaacagaacattattatgaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaaaatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccacttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcacaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaactagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggttatatatctatcaatggagtggattgattagaattggatctgtccaattgcagagcccctgttcctataccgccttttcataaacagatcaaggtcagtttagttggcatgtagtttgtaaaagaaaggagtagcagttagactagaagggtgacttggagtctcctagctgcatttacaaaggcacatttaaggcaccctaatccaaggcatgttcatttccacaagctttaccacaattttttattaataccataaacaccaaaagaatatagtgccatcatcatagaaatccattacattaagtcatcaatgaaaagtatactcagaagttcttgaactctgctcatgaaattcagttatcttttgaatatcataggcatcatagaaaaatgcatgaagtttcaactacatcttacttgtgatactttatcttattttttattattattttatttcattttatttgagacagagtttcgttcttgttgcccaggctggagtgcaatggcacaatctcggctcactgcaacctctgcctcctgggttcaagcaattctcctgcctcagcctccgtagtagctgtgattacaggtgcctgtcaccacgtccagctaattttttgtatttttagtagagacagggtttcactatgttggccaggctggtctcgaattcctgacctcaggtgatccacccacctcggcctctcaaagtgctgggattacaggtgtgagccagcatgcttggccctttttttttttctttttttttttgagacagagtctggctctgttgcccaggctggagtgcagtggtgcaatcttggctcactgcgagcttcacctcccgggttcacgccattctcctgcctcagcctcccgagtagctgggactacaggcacccaccaccacgcctggctaattttttgtatttttttttttttaagtagagatggggtttcaccatgttagccaggatggtctcgaactcctgacctcgtgatccatccgcctcggcctctcaaagtgctgggattttaggcatgagccaccgcacccgatctatcttatttttaaaaattatcactcaacgtacagctcaaatcatccatagtataattttatttagctgaaggatggatttgtcattagttccataactcctgttctctctcttgactttattttttatacacacaacatttaaccagaagacagacccaataaaaatttattaaattatgaaacaggataaaactggacataatgagacaaacaaacaaacaaacgcaaagtggtctaaaatgtttcgatttaatgatgatagcgtaacctgcaatcattcatatatgagagaaggcatcatgaggatctcagctttgggataggttttccaggaagggaactagagcattagtccagccctgttgtttcagcaaggacccctgttagcaatgacaggcatttataagaagtgaggccacactcatcaggtgcagagcacagcaaagctgcatggctcactagagtactgaatctggcatcacgctcatgttatccacttagtaaccaatggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagtatggcctttttctgattttgacctacattacattttgagagtttagagtaatggggaccatataataatattaatcaatcgataattatatatatatatttatatatttatgagatggaatctcactctgtcactcaggctggagtgaagtggtgcgatctcggctcactgcaacctccacctctcaggttcaagcgattcttccacatcagcctcccaagtagctgggactacaggcatgtaccgccatacctggctaatttttctgtgtgtgtgtttttttttttttttttttttttcagtagagacagggtgtcaccatgttgcccaggctggtctcgaactcctgacctcaagtgatccccctgcttcggcctcccaaagtgttgggattacaggcgtgagccactgcacccaaccccgataactttttctgtgtaagggcgtaggtactttaaatgcaaagtgagaaatgcagtattaccagggcagaaaaacatgctctgtgaacttatgtgaattcattattccttacttacaatgattgttcacatccctgtagtaaagaaacttctctacttacaacttcccataggtagcaataaaggtcccaggcacagcagaagcatggcaatgaagaataccaccaacagaggacatcagaacttactttaggccaccattaggttttcttagcctgtgttgtgttttgtgtgcatattttcataatgttttataaatattattattaacaccgctatgttcaaaagtacaaaagagtcaaaaaagtgttcctttaagaaaagacatgcgattactacggcaacaaaagagaacttattgtagaagggtgtacattgtatatattggtcacttttgtatgtcattttggacttaaaaggaaatgaatttccaaacagcccttgagaaccaattctctttgtagagaaaggaggttgtatgttgtctataaattataggatcatagactctttttgtttgttttttgagttagagtctcactgtcacccaggctggagtgcagtggcacgatctcggctcactgtaaccttggcctcctgggttcaagctattctcctgcctcagcctcccgagtagctgggactacagttgcctgccaccacacccagctaatttttgtacttttagtagagacagggtttcgtcatgttggccggactggcctcaaactcctgacctcaagtgatccccctgcctccagagatgatctggctgggcgtggtggctcatgcctgtaatcccaatcccagcacttagggaggtcgaggcgggcgagtcacctgaggtcaggagttcgagaccagcctggccaacacggtgaaaccccgtctctactaaaaatacaaaaattagccaggcatggtggcgggcgcctgcagtcccagctactcgggaggctgaggcagaagaatcacttgaacccgggaggtggaggttacagtgagccgagatcgcaccactacattccagcctgggtgacagagcgagactcttgtctcaaaaaaaaaaaaaaaaaaaaagagagagagagagttgataggatcttaaagtttatcttgtaaaattcccaggtaaaagagtaattctctgtaaaacatctttgtgcaagtactgttgattgtccccatatattttccattttttcttgtggcaatagaactcataattttcagttgggtatgtagatgcctgaaggaaagaatatatttcttagcctcacatagatgtaaatataatcatgggacaaagttctggtgaaggaactatcaggggatacatttcatgacagtttctgaaagattttctcacaacactgctggcacacgccctctctgtgcctccttccttcttccatgttgctgggggctggaactcagatgtgttggctggagctgaagcagacatattggaccatgtggtgacaacgagaattgaggccaccatggcaggacaaggtaaaggaggacttcggacttagtgaagcagaatagcggaaggaggcctgatctacctagttctgggcttgtacatgagagagacctacatttctctattgtttaagctattgttacagtttgtcctattagcagatgaatcagattaaaaaatgatggaaatttgtgaagcagcccatgccacttaataacaactctaacgtttacattttccttactcagagtaagctccactgtaacacttgcccatagttctcttctacaatcttacttaattaagtgtgctgtgtcctttacccaccctccccagatgcatgaagaagctgtcctgtattttcatgttatcttcttactgaacattctagattctttcaaatatttgtcatataaccatcgctatacctttcacaatcttggttgccctgctgtcaatgtattatgatttttcagtgttctcatcatacgtgatgctcataagtcaatatgactgcagatgtggtttaactagtgaagagattaatggaacatttgtgaatttcattaatgcaatctaatactgtattgcctcgtacagtaagccacaccagatcatactggagattaatacagtccttgtggttatttaaaatcccaatttgtttttcatataaagcgccacaaagtcagatgttcctcagcctatatttgtacaaaagactttaaaaatcttaaaggcaggacatcttgcttgttcttgttaaattttattttaatttttttattttggtacagtatcccagtctgttataatcttattttgagtcttgattttgatctttcagtgtgttgactcccattctcacctttgtgtcatttgaaaaattaataagtgcacaatgtatatgcttatctagaaaaatgacaaaaatctgggtcaaagtacaggcaaggaggcaccacttttagggggcactatttatggagggttgtgaaatgaagtagaactgaattcactctgtggttagcaccacaaaacacttctcaaattgacagtttaacacaacattcctccttgggcatggttattgaaacatcaccaaatttaccaaattatatttctctccatgtataattcatgtagtttaataagattgtgagcagccacgtaaaaggcactgctgaaattcagatacactgctgcagcataacaccactttaaaaaagccagttaagttggcaaagtaaaaaaaaaaaaaaagcctacaatattaaggtgaaaactttacaacatgactctagtgaatattaaagtctaaaataaaggaaaagaaacagttgctcaatgtttccaaatacggtttctcccagatttatagttttctttatttctttattttattattattttttgagatggagtttcactctgttgcccaggctggagtgcagtggtgcaatatctgctcactgcaaccttagccccctgggttccagcaattctcctgcctcagcctcccaagtagctgggattacaggcatgcaccaccacacccggctagttttttttgtattcagtagagacagggtttcgtcatgttggtcaggctggtcttgaactcctgacatcaaatgatctacccacctcggcctcccaaagtgctgggattacaggcatgagccactgcacccggcccccagatttatagtttttaagataaaagcgacaagccaaattaatgttttaaaaagctcgaaacatatggggggaaaaattaaacaaagtgccaagtagtgaacatacagctaaataataaaaagtagtcatactgatgctttgttattcaaaaatcatttttcctcaaagagtaagggtgaaaaattgtaaggactatcccactacatgttcaattaaatgactaaattaatgtagagacatttaattaaagttccactagtttttccaaatgctattaattacgccgctatctaaaattaaatctctccccaaacccttttacatttcttccgctcatctgatacagacataattaaaatgctgcaagtttacctaaacgcatccaaatattataaaagaaaatatgaaaaactggagtttcagtagctccttaagaagctggaattttaatgggatttctacaatccttggggaaaaccaatagatgtgtaagcaggcatgcacacacacacacaaactgtctcaagattcctctgaaaataaatttctctctttatatctaaggtgctgcagtgaataccacagacaactatagtttcaaaggttttctaccagcaaaagacaagaatttttgaagacactgggtaattaattgcaggcacaaggtgtactctagttataacacttctgtgctaccattttcgaaacaataagcattccttaatagcggctcagaaaggcactctttaagagaaacagtttggaattcaggcttccttgtattgtatccaaacttccaaatggaaaaaaaccagcctggacaatcccagcttcattctatatgcaagttattctccagtgagtaaacaaaggttgatcctaactcccaaacttattttattaatcatatacaagatgaaaacacattgatcaaacaaggtctactaacatgagacttctcttatttcctttctcttacttgattctgacagttgtccttttaattgctctgcacggatagtattcagccatctaaaatcaacaaattctctatttaccccagtcgtcttccagattgctgtaggttcattatgcaaatgttcctttaagaaatacagagttactccaggaatgaccactacctgccattactatggagtccagaggtagggtcaggtacaggctggggtcttttgaaagtgacttgtctcttttccaaaatttcatttgcttctaatcaagagtctggtaaattaggaggagtccttttctcactcatcatcgtagccaaagtctcatgagacaaggctgggtctcagtaggactgtgattcatgaaaagtcaattatggataaattttgtttaccaatatccttcctcattcctggttctgcttggcaaacagccatccctcctcccattctcttattacaagggtttgcaaacttcaccgcactttgtaatcctggggattttcaacaaatgctgatgcttggagcccacccccagagattgaattggtctgagatgcagcctgggcatgaggagctttataagctgcccaggggattctgatatgtggtctgcgctttaggcctgtcaaggtgggataacaacttgataataaaggtttatttcctgatcagttaaaggggttaccacatctcaaagaaatattttgcatactcaaaggacctgtaatggaatttaagttaaataatggtgttacaatatctgtaattaattttaaatatctcaacatagatagttggatattttatatgtgcagttagtgcaaccttcaactctagaggcttgaggcaaatggttattttaattaggaattcatattctaggacagcacagccttcatcttatgaaaaaggccaaaacccagagactgctactactatatatctctgtgaaccttggaggattttgtaatgcatgtaatagatatcgcaaatgtgtttttgctgagggaaatagtggattgcaatgaatatccctataggatctcattagtaaaatttaagacaatcaagatacatggattaactaaaatattttaatgacatcccctaacattgcataaacaggatataagaatccagcaaaacctgttgcttgggcttttaattttacgtctggtctccaatggccttgtatccaaccattggcttaggaagaattcttgtgacctgatgccaaatctaaaggtaagagaatactgtatttgcaatggtgtcaatttaagcctaaaatcctacacttcataaaaattgtagaacaggctgtaagctgacttctgcctgccttctaacaaatgttggttaacgacatgattgcacttgtggaggacttcagcatgaagcatgaagctgcggcttgaggtagccattcctcatccacctcaaacacatctgtggttctccattatttcccaaaaagaacctaatagttgcacgtgacctaaattcacttaggtcagttcacagcaggtggaatttgaggcagtgtgccaataaaatgagcggtaagtaaatatttggggtaagagggtcttctgcacaacgattaaatagttctaggtgattttctaatctcctcatttataagagtggtcccagcaagaacagagactgaaataaagtggtcgtttcaaagctttaaatactctgctttcagctactctgtccacttattcaaagacaaacttgaaaggaaacaggagcccatattatagcacaggcttttaaatttgtcaatatgaggaaccaggaaatgccctgttcttcttcggggctctttcatttagcttgcattccaggaatgttcatttgttccaagcaacattagaaattaatggggtaagtgctgggtgaatgtaggtaatcggtataaaggctgctttcttgagttaatgcctgagaaatcaccaagcctataatttcttttttcttttctttttttcttttttttcttttttttttgagacggagtctcgctctgtcgccaggctggagtgcagtggcgcgatctcggctcactgcaacctcctcctcccaggttcaagtgattctcctgcctcagcctcccgagtagctgggactacgggtgtgcaccaccacgcccagctaatttttgtatttttagtagagacgagtttcaccatgttggccaggatggcaccaagcctataatttctaaagtcctgtttcatttgaagtttgaatgcaaaagtactaatgactgcaggggagggatgttttctatatcttaagaaatacgtaaataatatgtggcatagcttctgatagtactgcaatataactatctataactaatatatacagcaaatatattatcacttcttttttttttttttggagacagtttcactattcttgtccaggctagagtgcaatggtgggatcttggctcactgcaacctctgcctcctgagttcaagtgattctcctgcctcagcctcctgagtagctaggattataggtacccaccaccatgcccggctaattttttgtatttttagtagagacggggttccaccatgttggccaggctggtctcgaactcctgacctcaggtgatccacccactgtggcctcccaaagtgctgggattacaggcgtgagccaccgtgcctggccctattattactctgcatgtttctgcagagatctgtagaaaattaaaaaaaaaaaaaaaagaatgctggcttataaatggagtagattttctggaaaatgaatgttttagtccgttggaatgctataacaaaatatcataaactgggtggcttatagacaaccaaagtttttttctcacaattctgaaggctaggaagtctgatatcaaggcgctggcagattcagtgtttggtgaaggcctgctttcttgttcatagatagcaccttcttgtgttctcatggcaaaaagggcaaagcagctctctgggtctcttttataagggttctaatctcattcatgtgggctctgccctcatgatctaatcacctcccaaggggcctacctcctaataccatcatatatggaattaggtttccacatatgaattttggggagacacaaatattcaagccacagcagtaaggcaatcacaaaatagggcagttagatttaagtgtaatatactagggaatgacaatgagagagatgtatcatcaatttctttgccttctcccctatcatcagggaaggtacctaactgctccaaggccacatgactccatgcgcaccaatagcaaaaactacatccaatgctttataggttaggaaagtacaggttcccacacttatatgtgctcacttccatttcttgctgcccctctctttatttacgaaaggatgagaacttgatccacaagtgatttcattgagatgtaactcttattttatccaaagagaagtgttggaacatgctttgattatcaggtgagggctctgtgcacattttcatgcaaatgtcttagattggtaactctcctccaatgaatgcaagaccttctgccttcggtgatgactaaggtggtaacagttatcaggtagttgcttggcactgacttatttactagacattctttttttttgttttttgtttttttccagagagtctcactctgtggcccaggccggagtgcagtggcatgatctcagctcacggcaacttccgcctcccgggttcaagcaattctcctgcctcagcctccccagtagatgggactacaggcaccaccaccacacctggctaatttttgtatttttagcagagacacggtttcaccgtggtggccaggctggtctcagactcctggcctcaagtgatccacctgccttggcctcccaaagtgctgggattacaggtgtgagccacattgcctggcctactagatactgttaaggcaggcatgtgctaaacaggtcacatgacctctactatccctggaattataatactagttagaacaatagttttcaaactttgaccatgacctacagtaagaaatacattcatcatagttacttagaatacattctccacacgtatacattcatgggtgtatgtgtgtgttgtttgtctaaaataccacttccccaggaaactttccaggcctactacaccaggtcaagtccctctgttatactctctcagcactctgcttttgtcctttctaagtactcattacaattggaatgaaataattgcataacaaagatgttgaacccatctctagatctgtattctagggctttctgagggcagggaccttcttcctctcttatagaacagcagtataggaaaaactgacctgaagcaataacattttgcacataagagctgcttaattagtacttgtgacctgagtaaatggataaagacctcagcaaggagatccctgggtccttttcttatttggaaatcttgaggtagagctggagtaggtcatccaacatgttcattggcatagcttacagaacaacagcatcaacatggtgccaggacagataggatgtatctggggagcaaggtgtgatacgagagcgggatgtattattaatagttctaccttttctcattattttttcagggcttgaacatgtttcttgttggtatccactcatatttattgcctctttcttcatctcatttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttggtcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatcaaacttcttcttataaccagacgtggcttcatgttccagcaaagcaagatattcccaggccataaggtaacaaaggcctgggacactgtggtgtccacatttctcacttctatgaatgagtgcccacaggaatgtgttcataacatgtaacaaagtcaacttgtgagttgctgatacacatctctcttatgtcatacaactgctgccattagcgattcatggcagtgtccttgcccggcagtcatgcatatccaaatgaggcatactccctagctattacaagagtcctgtctggctgcaggcattgactgacttctcctttttatctcaacttaaaatcagtgccttgctcccatccagtgccacatgaaatccaaggaatcaaagtgtaatctccgctgccactcctcatgttcaaaacatggaccattatgcaatattaaagcatgaatcctggaactctgttaatgttgtgaaataggtgagtagttagcaagaattaccattctgacagtgcagtggaaaaacttcattcattgtaaaaagcagggagttgagtttctatatggggttgcctttcacgtcccctccccttgcagagataatgaaaaaatgcccagctatttttcagatgtgatgtttactttcttttccaagaggttctttggaggaatacacagaaatattttatagaaccacaaaataatagaggtaaaataagctttggaataaaataagcaaataagactagtttctagtctacgatttctgggaaaatgcgagaactttagttaaacttgtttattttattctaggtgaattttattaacttaaaggatcataaaataataatgatcatctctacttttaaaatccacatttctatcaattattatatgcatattccagtgtgtacagataaaaagatattcaagtacaactaaacctagagatttcatcagaaaataatccccaaaatgagctgctattgcaaaatggaaaatatgatgtaaacaggcattttgggctttcagataaacagcataaatttttgaacaggatacgtcttgttttccacaaagagaaaaacaaggtgtagtgaagagcgttgaattgtgtctgatttctgatcttgcttttaacaaatgagaacgtctcagctaagtcaaccagaaactatttcctaatctataaattaaagggtttggcctagataatttctagtcttttctggcttcaacccctccctgcttactctctctctctctctctctctctctttctatatatatatatacacacacacacacatatatatatatatatatacacacacacatatatatatatatatacacatatatatatacacatatatatatgtatatatacacacacatatatatatatataaacacacacacatatatatatatatatttttttttttctttttctttttgagacagagtcttactctgtcacccaggctccgggttcaagcaattctcccacctcagcctcccgagtagctgggactatgggtgcatgccaccacacccggctaaatgttttttgtatttttagtagagacggggtttcaccatgttggccaagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaacctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaaatctccaaaccactgggcagttataagactttttttttttttaagctcaaacacaggtcaaggctataggtgggagttcttgaacaataaacaaagtgagaaatggtcttaattttttgttattgctgctttgaatgacacacagacacatgtactaacacaggcaagactcttgctgcacggatatatgtatttttgtagaaaagatcaaactaaaatgaattcactgcctggcatcatgttttcatctgccttccattttccacaagggtgtactccacttgcttagacttaggcaatttaaaaattcttgatcttaatgtcctctaaaatgtacagactttatagcttagattttaagagacaccattacctgacagggtaatgacagttttatttgcactggtgactggatttgctgtgatacttaagcaataatacaaataaaatgataatttttttgagaggatgtcagggaaggagaaagaaaagaacaaaatgcatcgcatttaacttggtttaaaaacacaacacactgcagcttcccaaagcttcttattttactggaaaaaaaaatcccttagcaattcatcttcctttgggcgcatgaatgacattttactgtgatgtgattataagaaacaaaatccctcggagatgctgccttaaaatatttttctttataatgttctgagctcgacaaaccttggtagaaaacagaatactcttaattatgaataaattaactaaattagtaacatgagatggatatgcaattaagggattgttaattgaaactggaaacacagctgtatacagcttagagatgaatcataccagtaatgacgcagatgtttataaaatgtgattatctttagtggagacagcgctgcatctcccaagcccattcttatattgtgtcactgaaatggtttttaaacccgtgaacaccaggaatcaggatctcagggacggcaaattaggctccctggatatgggaattagtgttgtctgaatgtcagcaatttgattctccagctttcaaagaatgtagatatggagccaacaacaaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgccgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggtttctggacaaagcttgtggcattattcaaaccaacaactattaggctggatggtgcttacaaagatggaagatggtagacatcagttttttacgtaaagtgcaaactaaccactgtaaggtgtagtcaaaaaagaaataatacataattttagatattgaccaacagaagatatatttgtcaccttagcttagcttctctttcaaaattatcaatgtccttaacaaaatctagtgctgtaaaggaaaataaaacaacagatagtctgacattagttaatactttcctctatcaaaaggatgcagaaaacttagggcatcctccttgaattcaggggagaccttttactacaacgtttaacgaagtatttggatgacttgaggctcaaataaacaactcagttttccactgtgttgactgtgggcatatggggtgtagctgagttgtgagtctgttaaaagaaaatacactttcaggaatgaataaggagaaaaacgcaaacacataaaaagacacaccactatatatagttttctctctatgttggatacctataaatgtgggatttgttgaattttgatcacaaagtctttctatcctatgtgttagtctgcacaagtacaggctttgcctataatttcagtattgatttgctgttatacaggttccaacttgtctaaatttcattacctgaagggacagcttgcaattccatatacaggtataataaaagcaagatgagtacatgcatactgtgagctctgaaaaggcactttttctacaatggctgtgccaaattcttcatgagactgttattctgttgcaaatggtgataagaaagccaatatcatacattatttactagcatttgtactaatattttcaattctgaacctcattataatcacacttgtttcagaacccatttgtggacatacccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgttaaaaaaaaatatattcccaagtctattgcatcagaatctccagtgaaggggcttgtgaattaataatttaatcaagtgcccctggtgattcttatgaccagaaaaccttgggaaagacaaacttaagaactttaaagtcaggtatctgttactggcctctgaaagtattctaactgacattccatctgcaatctcctgtttcaactggccgcagctccaggaccactcaggtaagcagatactagctcttgccttggcaaatatattatgaagtcttagcttggagagcctttgacttaaagtgaggtttacatttctaagatgttggtttcttgacttaactgtctatttgaattcctgatcttttccattcagagcctgtttacccgaactccccacttcagctacagtctgaattcctaacctcgtgtacattcttgatcagtgttatctggtggcctcaccaaccctgccagaatttcagagcccctctcaagtaattacaggggtaatcatgcattccttaactcttaggctgcattcttagggggcagattcctacctactaaccttgaacctgctgatgcccatgaggctggcatgaaagcaggaacaattagtctgttaaaaactaaacatatattcctgaagtctgaaaaaaggttctactcatccaaatagaaataattgagaactctaaaatatttaactttaaatggtctggaatcatcaatgttctttcaggttgaatgaatattttacattaaaaactttctgtcccttgtttacttggccaaataaggtaaaaaggtcaaaacaatcttagtgaaattgtttccttatgaatgacaaatgtaaagagtcaaaagaggaattaaggtaaataatttaattatatttcatctcccctaattacatgtttttcatttgcttagatattacttatttcacctctgctgccttccccaccatatacccgataactcagtcattccagacttataaactacctcaggttatatcagatcttcccagacctggttttcttcctagaaaaccattccatttttttctttacctcttggaaccctactcattgctcgagtctaagctcaaatgtcaccccttgtgcaaaatttattgctaactcttctgcacattaatatcatttctggggggctcacatctctagtggagcccttgtaatactgtatgtagttcatgtattaatcatctttgaagggagcctgtgtcatgtacatctttgtccctcctattgggtagagggtctcgagactaatgtagtcactgataaaatactgaactgaacttcatgcaaaagtgatttctgagaaaaggcattaaccaaatagtgccttaattttattacttgttttgcaggttttatgtacttaattgcaagtaggaggctaatgaaaaatgtttagtttttgcagtgtggtggtggtgaggggcatcccagcttgagtggtagaggtcccagcttaacacagaaatttagataaatgtggcaaattggtgggatgggcaatgtatctcatctgcactgagagaaaagctcaaggtgtaaccatttctggggctacatgtctagtcatctctaagagattggtggctccccagacatccattgcagggacactaaggaggtctcttaggagaaggcgtaatgaaagaacatattataaaccaggtgctttgctcagtagaaaagcctcggtcaacaagagaaagagaaagagtggttttgagaatactgtggtgtctgctacttagatttatcttctggttcagtcatatctgagtcccatgcatctaagtcagaattatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttgtacatctggctcctcacttgggatggctgcggatcttcggccaacagctgggggctagccacgtatttgtctttccatgcagcttccccatgtggctagcttagatttgtggcttcttcatgtagacagcacagtggccttagagtagacttagtacagggcagatcactttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggggaaaagaaaacaagagtatctttcttccccacaccctggggattaaacaatactccttttgggcctgtctaacaggacaactcatcccattttcccagccctagatcctgactatcagcagagaattcttgtgcttggtgtaagagcagaaaaggctggaaaggcagcgataatgaccaggatcagcatctaactcacccagtggcaaaggggccaccacccacagaaggtttaaaagtgtacactcaacagataagcagtaggtagcattcataatgggaaaatatgactctgaaagaaaatttttatgtggcactgagatactttgagatgcatgatcaatgaaggacctaattcaaagagggtaacattaaaattcccaagtacagcacagccacaaaagctgtagccacatgggcaactttactgcccctacagtttaagtgtctgatgggaatgccagacctaagaattggaattgggggtcctgacttgtttgaagcaagttaaggtcttttttttttttttttttttttttttttgagagggagtctcactctgtcaccagtctggagtgcagtggcatgatctcagctcactgcaagctccgcctcccaggttcatgccattctccagcctcagcctcccaagtagctgggactacaggcgcctgccaccatgcccggctaatgttttgtatttcagtagagacaggatttcaccatttggtcaggatggtcttgatctcctgatctcgtaattcacccgcctcggcctcccaaagtggtgggattacaggcgtgagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttctttcttttcttttctttctctctctctctttctttcttttttagatggagtctccctctctacccaggctggagtgcagtggcatgatctcagctcactgcaacctccacctcccgggttcaagtgattctcctgcctcagcctcctgagtagttgggattacaggcatgcgtcaccatgcctggctaatttttgtatttttgattgagacggggttttaccatgttggtcaggctggtctcgaacgcctgacctcatgatctgctcacctcggcctcccagagtgctgggaccacaggtgtgagccaccgcacctggcccaaattaaaatattttcattgcaaatacaaaataccaagaggttctatatataatctttgaaagtaccctttctatttaaagatcaggattttttttcacatgtctagaaagaaatttggttcaattctattcactatgtatttattgggaacccattagatgtgtaatataatcaaatatcaatagattatagaaaagaagagagtcctttttcttacaacccagcagggcggaaaggattaaattcttcttataaagggagaacaaatagattagaaaagacgctgcgtagtcaagttcagaaaagtgagaaagtttagaaaggtttcatagagatgaactgcagttctaataataaaacttaacatttttataacatttgatagtttcggaagcagtttcacagaccttatctcattgcttcacatggaccttgtaagacaggtgggatttggataagtagttcctttaaaaaatgtcttcgaatattgtacatttagactgacaaatgcctttattagaataaagggaaaaggtatgtgagagacatagagagcaaattttgggttctagttccacaactaactagctgtgtgaactatgaactatcatgtggtgtctttgtaaactcaagggttggatttctggactttctgtgctgaagtgtaaaactaaaaatattaaaatattcagtaattcaaagtggatattttaaaagcaatgaaacatatcagtagattcaattgttttcttatttatttttatgatttgatattttatatttttagatttcaatttttattttagactcaaggggtacatgtgcaggtttattacatgggtatattgtgtgacactgaggtttggagtacagttgaacctgtcacccaggtagtgagtatagtactcgataggtagttttttcagcccttgtcccacaccctcctgcccttgtcactagtgcctgttgttcccaactttacatccatgtgtacccaaaggttagctcctgcttataagtgagcacatgcattatttggttttctgtttctgctttaattcgcttaggataatgacctccagttccaaccatgttgctacagaggacatgatttccttctttttcatagctgtgtagtattccatggtgcatatatgccacgttttctttatccaatccaccattgatgggcacctaggttgactttatgtctttgctattgtgaatagtgctgcaatgaacatatgagcgcacgtctttttggtagaaaaatttatatttctttgggtacataccaagtaatggaagtgctgggtcaaatggtagttcttttttttctttctttcttttttttttttttgagacagagtcttgctctgttgcccaggctggagtgcagtggcatgatctcggctcactgcaacctccgcctcctatgttcaagtggttctcctgcctcagccttccgagtaactgggattacaggtgtctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttatttttatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattacttcaaatgatccctagttattcaatttacatactggaattttacaaccctgtttagttagtcccaggcttcaggccatttaaaacaaaagatatagatgaatagaagagtcactcagcttgtcttcatccttcagatctcggtcaaaggtcacttttattgggagggtgtcctgattgccctttcctgcctctcacccttactgcagcgcgcgcgcacacacacacacacacacacacacacacacacacacacacacacacacacacacatttaggtccttactatatattctggtagtgtcctgtattttctttcctgacacatttgtaattattttatgagatttaaaaaattactgtctgtcatcccaagaaaccataacctccatgagggcagagaaggtctgtctatgactgaatccctatcatctcaaacagagtttggtaaagagtagacaccagaaaaaaataattattgaatgaatgattgaacaaaggaggatttccgttcacttcagcaagactttgatgattcaaccctcttggtcctacagaagagtgattctagtttttagtctgtgaatgattcaggctctgagttaaacaggcaattcttgagatcgtggtctgaaattcatacaaccctcctactttaaatttcctcaactcatgatccaggtgattcctgacaaattaataaatgtgagaatgatgctgttctttttgtttaaagggtcgaatcataaatgaataggaaatgttgtcatgtcaattcaactttttatcagaggagtggtactgcatagttaggagttctgacagattccccaggcagactgtctgggttcaaatcctggctctctcacttacctgatatatgaccacaggcaagtcacttaacccttgggctcctcatttttctaacctgtaaaatgaggttaaaattgtacctccctcactgggttacgtgaggcttaaaagcattagcacatgcaaaagtgcttataattgtgaatggcatacagtaagtgctaggtaagttctcactattaatctcagtaagcgtaatgctcactaaaattattttcaaatttataccatatgactacattgattgtctgaataaagtaaaactatgtataaaggctgtacttctgatataagaatcatcttctaatttattatatttccaccctcccgtctcctttagtaaattaattaatatattaagggagaggacaacttatatcacagtgatcattatattaaggacattatagcatttataaaaataaagaagtattatgataaactgtatgaatttgaaattcactttgtggtatttacctttaaaagtagcatttctgaatttcatacgctagtttccattcccctttatggagttggctttaacacgcagcttctcatgtggcctgaaaggggattctttctactttctagaggaatgtgctgtgaaggaggagtcgggaatcttactggcggccatgtgagaacagcagctctttgaatgctgggtatgatgtagcatgggaactgtgagcagctactggcggagtgtttcacatgcagcgcagcggggcagtgggaaaggcaatgaagaaaacaaccagtgcaaacaaatgcagaagaaagggtggggcggggtcaaactccagggaaggagagaggtcagcccagagagacaagaacacttacaagaacaaagaataaagcagtgagaaattggagacaagggcaaatgtcagttgcagaataagggaaaaggacaagaaaacatgaccatcatggcaattttaaatgcctggaattatatacatgtttctagtaaggaactagaggtctcaggaaactaaaataaatacatgcatgcataaatacattttgctatttaaacacatttactaggaacacattccatttttaaaaacaataataaacacacttacatggattaccataatagctagccttagaactagcaaaaatagttcccgattaaaacaaattagaaattagtatataaagatcaagcaatcaagtagcctaattaatactttataatgatttgggttcactttataaaatatctgaaaataataatatgcttttcattctcttaaattcataaatatttctttggctcctgatggcttcattcccattttatacttcatataattttttcatcacattctgtacatcgttcatttatccccctgtagtttcacacatcctgatgccttcaaaaaaaaaaaatagagaattcccttgaaaaccagaccattcttctcctagggtgagaaagacagactctggaatatttgggccatattagtttcaaggctacctgagcaatttcgataacagtcctcttgactaaagtacaattagttgtacaaacattgaaaaccaaatgttcttaagcttgacagtacgctttgacctcagtatgctctaagggtggtcactaacctgggcatttaaatttatactctccttcttcaattctttaaagggttttgtttacatcctttttttcctaacagagttgaggttaagcataaatgattattctctccttactgaaaagatgttttcctggaacttaattgtccttttttcacgggtcattctattcctaatatcaacaaatccttctgtgacctaaccttttcaaaaacaaacacatacttctttcttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgttggaaaaaaactggttagtttttttaaaatgaagccacacaaatactcctattgtttagctaactatgatcccatcacatcctctcacaaagcttactactatgactatatagaccaagtttccagtaagaaattattgaataatttgtaaaccagagataataatgggtactgcttttgtagtatcagtgttatgatagtatgtaagtatgtatatttctggtttttaacactgagaaaggatgagaggggtgggccatcatggaagtaataaaagagaacccatctttaaagctttacttaatatagcataagcagtaaagggagttttgtttagtatgtccttggaccaaacaggatcattacaatgtcttctaggtacacagtagatgctcaatcagtgctgactgaatgaaagaacaaagggatgaaagaaggaatgaagtttgcaaaagatgaggctctagatccctgcgacagcaagttaccacagaggtatacagatggagtgtaatgatgtctacatgactttggaagaagcttaggaaacctttaaaaaacatacataatttatgatactgttctttgacatatgtaaagaatctaatagctggaaatgccttcatattattcagattttaaaggtgtttgcattccatgagttcctacagtcaataaaacaaatactccttatgttaaagtgtttttgcagcttttgtgctatttgtgggtttactcatgagtaaagaaaaatggtataatattcctttatatactacttgcgcttggtgaataaagagattgactgcattactcagtgtgtgtactatttcaaaattagaaaggtttatcatcattttaacttttttctcacctggtttagatattcgtttctacttggtcaaatattagcattagtttggctttaagagctgattcactgaaatcacttttggctgattttagtacaattgctgagttctaaaggcaatgaggaatataatgctttaaaattttatatttgaaacaagtgtgatttctaaggggtacactgaactgggttcattaatccattggtttataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataataggtaatcataatcataatacaaaatcacaaggttgtgattcttagatgagagaatgcacatgaggactttttctaactgcaaggagtgatggtttcctacaccacaaaaagtcaaatggtcaaatagtaacatgcataccaatgtgtctactttgaggaagaaaataggacttcattcccacagaaaatttcaaacaggcaaaccaatgtctcttacatttctattagaagattcaaagtcagtttggaattctctatacattatgattctatacataggtaaattgtgactgggtttgactgtattgttggtgctcacatcccttaactggtttcaccattttgactgatattacagacagctaaaaaactagcatggctttccttgaaaattaaatgaatggataatgcaaagaacccaggatattctgatatcaagtagacacggcctgatagtatgtaactctaatctttctattatactattttgcccaaatttaagactcttcttcttttctcaggtttacatctgcctttctactactccagttctctatttttattttattttattttatttttgagaccgagtctggctctgtcgcccaggctggagtgcagtggcacgatctcagctcactgcaacctctgcctcctggtttcaagcaattctcctgcctcagcctccagagtagctaggattacaggcacgcaccaccacacccaggtaagttttgtatttttagtagagatgaggtttcaccatgctggtcaggctggtgtcaaactcctgacctcaagtgatccgcctgcctcggcctcccaaagtgctgggattacaggcgtgagccaccatgcccagagagttctttactttttgattgttctttgtcttagtggacagaggcaaagatgaacttgtacttggtttttatcacgatttaaagattgacatagcattgtgactaaattctttattttcatagaaatatgtcttttttgacatttactatttaaaaaaatatgatgtcataatggtggtgggctcaagcttcccgccatagaacttggataatgcgttagcctcacatacattgttctaaatataaaatattctcaacaggatgtatgaattgcttttccagtaatgggaaaaaaattgcttgatgtgaacctcatttcttgctttcttctctttctgaacaaggcctcacatttataatgtagcagaattactatcaaagaaaagaatggaactaacttgactcggttatatgcaaaccaaaaccttggatttatcagctttctgctaaaaacactttttaagcatatctttaaggtcatgttcaaaaatagaaacatgaaatttgctacaatatagagcagacaccacaaactgaactgtttaataggagaaggctgtgtatatgtgggtttagggaagaagagattaaaagttagagttatacaaggagaaatataatttcaacaaaccacatttgtattatgaataaagaaaggaacttcattggttttaaactaaattctgtcaaatgtgtatctcccccagatatctagagacagaatcataagattgaactgtatgtgaccttagacaaaatagatttctgcattttaaaaatgaggagaattaaagctgagagaggttaaatggctttctcacaataacacggtcaaataatggctgagcttaagtttgaagttagacctcctaatagtcaatccaatgctcttttcgctatatcatactatctccttacatgtgttttcctgtacttataaccaagtttttactcattgtaaagaatggctacatagtaagctatttactgtttttgataccttaaatgcaaataaatagtgcaactagaatggatcacttagcattgattaaaaaaaaaaaaacttttcttactagtcataatcctttgacctcatttggaaatctacctgccactgtcacaaatcttttaccacgttctgaaagcaaacgtggcattctgctctctaaaagaaattataaaatatacttctagaacacttatatgggactaatgtggccattggttttctttggacatttattactttccttatttatacttaagatgaaaaacatactaaggatggaacagataaaattttaatagtactcaactactatggagcaaacagagaaaggcatataatcacttagctatatcgccttgctttagtcgatgccacttataacaatctagaatacaaatctttcaggactatccatcacaacaagaattaaattatgtgagatctcaagaggtctgggatttgcaacttatctttattaaagatctagcaattctttaacaggcctctcaatcacacccctaaatggactgacaataggaaagtgatttggtttattatatttttcttattaaaaagttaaaaccaaatagttttaaacccagtttcctcagaggcataccttctgcatcctgttggaaaggagaaaattggaaaggagagaaaatgattctctaattctacggttaaactaattttagggttttggggtataacatggtgtccttcacactgagaaggtagacgcacctcttccaccactacaaccattactctgcatgaattaactcattcgatgttacagtaaccatgttagagatgagtaaatggacaaccacagagattaagtggcctcaaggtcactcagctaatatgttggattccaaaacctgtgtactgtaataataataataataacaacatcaagagctagaatttgtagagtgtttatcatttggcatgttcgctcccgagcactttccatttattttgacttattcatcctaataataaactgatattgcagagaattttattatcgcatttttttttttttgatgaaagactgaggctcagaaaggttaagtaatttgctccaggtcccatggctagtaagtgtgaccttgagcagcacacttacattgcctgtatttattacgcaaacctacgaaaaacttccacatgtaagtttgtgataggatgctctttctttaaatgacttttggacacatcttactattgactcttgtttaaattaggattctaaagggaaagatgtttttgagaatccaagcagtaagagtacaaaggaactgcatggtggcaattcacatcttccatcatgattcagcattattttctgtttatcgtaagaatactgctacacagagtttggatgttccctctaactcgcgtgttgaaatctgatcccccgtgttggtggtgaggcctagtggaaggtgtctgggttgtaggagtgaatccctcatgaatggtttggtgccattctcacggtagtgagcgaggttttgctctagcagttttcatgagaactggcacctcccctccctctttttctcctcctctcttgccgtgtgatctttgtacaccagctcccctttgccttctgccatgagtggaagcagcctgacgccctcgccagaagcagatgcttcttgtacagcctgcagaactgagccaaataaacacctgttctttatgaattacccagccccaagtattcttttatagcaacactaaacagactaagacatatactaagtcttagttgcttccaaaattaatattaataatttgaaaatgtttagatgggaattataaactaatataaaatatcctatcctcacaaatattaccatgaacattacatgaaaaaagtactttcattgttctttacaaattttatctgtatattattttactgtaacaaaggacaacaatgtttacaatgtgcttacctgcagaagcttccatctggtgttcaggtcttccagagtgctgaggttatacggtgagagctgaatgcccaaagtggtaagctggcgagcaaggtcattgacgtggctcacgttctctttcagaggcgcaatttctcctcgaagtgcctgtgtgcaatagtcaaaagcaaattggaagatgagaatatttaaaacaagaagaactgatacctgggcttattctctttagggtgcagtgccagtaatgtttgctctatgctacggtttgaatgtttgtgtcccccctcaaattcctatgttgaaatcctaaaaaataaaaaggaaacgaaatcaaaacacctaaggcaatggtattaggagatggggcctttagggaggtgatttttgggattagcgcccttataaaagagacctcagagagctagctagctcctttcagcatgtgagggtgcagtgagaaggtgctttgtatgaggaatgggccttccccagacaccaaatctgctggtattttgatcttggacttctcaacctccagaacagtgagaaataagtttttgttgtttcacaagctatccaatttatggcatttctattatagcagctggaacagactaagacagtctcttgtggtagtattataacaatggatatttgttaatgggggaataatgataactactatttgttgagcacttcctaggtgcctaatgccatgatgagctctattcatacataaactgattttatttctacccaacaatcctatgaggccagtagttggagaattctaattttatacatgagaaaacaaacttgcagaggtttgttttcaaaacaaacaaaccttgccaagctctcatgggtaaaaattgaggaacctgggatacctatatgcaggtttgcctgcctctagaatatatattcttaactattatgttatatgcttcccctaagaaattctggattggcaaagtaacaagaaaaatatattgctgctggattctaaattctactcatgtcacaaccagaaatggatccttattttttacaatagaaagatatattcagtcataaaatattgcatgcatactttgcaccaaccacatcataacagtttcatttagggagtagggtattttgtcaagtcctcagaatgacttcctgatctcctggtattttagcccttgtagcaatgacttcagaaggctcccgtggggcttctcagctgtctttgaagcactagagcaggagtctctgatgcaatacatcatagcaatccgttgagcagaagaaccctatgcagatatggggaggatattaccacgcctcatatctaccctatcgagatggcatttatggatctttaacatgatgcatgatgtccaaatgttccaataagcaatttctaagggacaaattccctcacttaggagaacagtttgtgtaatgtaatgtctgtgtacaaggacagcaccacttgactatacgtgttgttttgacttgcttgatctgggcaggtgttatttctctgtctggttcactatgttgataaaaccattggttacactgacctcatttataagccttgcatttcctcccactccaaataaaaggagccagtatgaacattcaaaataagaacgacattatcctctcaaatcaacctgaatacttcatcagtaaaccgtggtgctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaaggacaacggttacaaaatgaaatcattctcttctggataataacgtgcatttctagtagccacaaataaatatcatgtgaggggaaactgtaaacaggaacctctgcagagagggcaagccagcaggcagcatctttcagtgatacaggtgagtcctttgtgctaatcatctctctttacaagcaagactctcaagccattaagttgattatcctacctcgttaagccatagctagatttcagttccctttaggtgacacaatgtacattttcaaatgtctcttattagaatattttgattttcattttctctcccaaattcctgagcacacatattaatcctgcttcaatgttttggaggatgaaggggattcaaaaataagttttggtactcataattaattgcaatgctctcccttttcctctttttttttctttttaaaatttacttttcttctttaaactttaccataagatcttgggattttttttttttttttttttttttttgcttctttcaagcaatgatagtggaagttctctgaactaatctccacttaagactcaccaaattagccaaagtcttcattctctttgtgaaacagcagtgatgggaacctctcacagcctcaataaaatgttcgaggtgcctgtcagtatgtgtggaccttctgctcccatcagttgacttgttacaaccgtcagttgtgtgtatgttctcaaacctatctttgccagtaactgttgtgattatgtaatttaataaagaaagatttcctaaatcataaaaatattagtttaaaaagaaaagaaaaaagttattatttctataaaaaccaggccaaatactctggagagttgcttcaaaaagaaaaagaaaataaatattgttgaagtagttgtgaacaagacaactgctaaagatgaagaaaacaacccagaccaggtggggtggctcaagactgtaatcccagcactttgggaggctgaggtgggtggatgggtggatcacttgaggtcagcagttcgagaccagactggccaacatggtgaaaccctgtctctactaaagatacaaaaattattcgggcgtggtggcacatgcctgtagtaccagctactcagggggctgaggcatgagaagcgcttgaacctgggaggtggaggttgcagtgagccaagatggcaccactgcactcactccagcctgggtgacccagcaagactctgtctccaaaaaaaaaaaaaaaaaaaaaagaaaaaatgccaaatattcagtttaatctgaattcctaaatttctgttaaaatatttgacaatggaagctttgactggtgtgaggtcagttgataaacagataactgggggcaaaggttcactttggggaagtctctagatggggttgagcagactaaaggacttcagtcagctagaaatcatcatgagggcactcaacgcatgaaggtggaagaaaggagataacagatggtaggaaagataaaaaggaaaaggaggcaggagaatgctcatgtcagtcttcactttggcatttgatttaggttttggtagcagcttttaccacccaaggatggctcaccactgtgggctctcagtgcccagcagcatacataacaagaagtatggccgcctaaacacagagtcacaagaccttcaccctgtaaagggtgaacacaggtactttgctatttaaatagatgtgacattggtttggctatatttcacagattagagcttttaatatgacacacataaatttgtgtttaaattattaaacactacacctaaaatgtcaaaaagcacagttaacgctgagcaatacgaggtgctatttaagtgatatcaggattgcattaggttttttttctagtttggaagcagtaagtgagaaaacattgaagaaagccattatattgtgggttttctttgaatcacttaaacatctggaatatgttctccatgaaagagcaaaccaagtctaattttattatgactagtttctcacaggcagaattttcagttcattaaatgttgtctgattatagatacaaaagtactgatttagaatgataggtaagtctgatataataagtttttcttcatataaaattaaattgcctgtcatatctttgcttatctttatgtagctaaggatttgttcaaatacacatttaaaattatagtcatctactacttttctaagaaaataaaggaattgtctattaacaagggaatcttatttttgagggaggaattttgacttgacagttaagagaacattcctactgcaaagcacagaaggtcagttggaaagactagaaagagtaaattgagggaattctgcttggaggggttttatttcctctgtgaagtaggaatcaacagacctggcatagtctgcagtgcctggcatagcgtgcagtgcctggtgtgcaatgaatagtcactgaatgaaaacatgaattaagggtaagtgggaacatttgaattaatcgtaatagagactgtgagagggagttgacctaagagatgtaatgaggttggcaaacagtgttgagggcccacttgaggatgaggttcaacattttttagcagaaccaatctgcctgactttctcattttctccaacagtgttgcatgtaagcatggggaaaacagttgatccaggtttggggtttcgtcagatgactgtggctcacacatttagggataagggagtttcgatattagccaggatgtaattgaaaaaatatactgtggaatctaaactggattaggaggaaagcaaagcaaaatgaagcttgtagatggagagaaagtagaggggtcagttgtagaagtccaggataatccataaaaggccacagcaggagtagctgcacaaacaagcgacagagaggggagactctgggatgctcagattagctctactggatttgccacttatgagtttatttataaatggtgtgatatatatatatatatatatatatatatatatatagatagatagatagatagaaatctggctatatatatataaatatatatagtgctactcagtgtttgaaaaacttcccttcttagggatattaaatattcctcctaaaatcttaacctgctaactcatagacgtcctatctcacttactaggaattcaaaattactaggttccaaaaatgaagtgttattcttgggctacatacacgtgcagagaaatttatgttacaaatattacttaagtagggactaatggcattgctgtctaccatgaatccttgtcaaacaaatgtttgttaaccaagactcttggaaaacagcctaaaaagaggaggtgctaggaaagaaaagtcccagcattcttcatgctgagctagtcatgagaaggcaaggatgagcaattagaaatcatgtcctataaatactggtgtttagtacttattccggggctcttcctcgtggttcagggaagccctcacagaatgcaattacccgggaattggcagcaggtacagcccagctatgttttgcagctcctgcatttctcagcagatatatcatcctcatggggccaagagagtcaaggactgtatcttgctttttccagaggatcagaggcctactggaatctctcaaatacctgggcggaatgagctactcaaatgctgttgaaacaattaaaaagaaacacaagttgagctgtaagcaagcccttcatgaaatgtatcaggctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaaggggttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagacttttcttttcttttcttccttccttccttcttttctttctttcctttttttatacaggagacttctttctttctttctttcttcctttctttttttcaagagacttctttctcttttttctttccttccttccttccttcctttccttcctttctttcctttttttttttttttttccaaggtggagtttcactcttgctgcccaggctggagtacaatggcacgatctcggctcactgcaacttctacctcctgggttcaagtgattctcctgcctcagcctcctgagtagctgggattacaggtgcccgccaccacgcctggctaattttgtatttttagaagagatggggtttcaccatgttggccaggctggtcttgaactcttgacctcaggtgatccacccacgtaggcctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaagaaatttagggcttttatttcccaagcgattatcagtaattatattttaactatggtttcttctcagactcaacacgcttccaaatttgtgacattaaaaaaatagcaattaactgctctgtgttttccataaagaatccacatctttttataaaaaacaatctcaaccaggtgcggtggctcacgcctgtaatcctagcactttgggaggctgaggtgggtggatcacctgaggtcaggagttacagacgagcctggccaacacagtgaaaccctgtctctactaaaaacagaaaaattagccgggcatggtggtgcacacctgtaatcccagccactctggaggctgaggcaggagaattgcttgaacccgggaggtggaggttgcagtgagctgagattgcaacattgcactccagcctgggcaacaagagcaaaactctgtctcaaaaacaagaacaaaaaactctagtttctctttacaatatcgaaaaagaatatatacccaaacataaaaggataactttttctttttaacattttctctttgcactgatcataattcttcatcttttaggacatggctttctatgaagcttgtaactccaatgttcttataataaaagccgaattatatcttggccatattaacagtgtctatcttctttcttttctgggtgctcacatttccttcatgtataaaatttggaaatgaggaacagggaagtattgaccacaaaggaaaagtttttatttttaagaacaagttgaacatagcaggagcaattgatattttgcaaaccatacacccggtaaggggtcagtattcaaaatacacaaggaactcctacaactcaatagcaagaaaacaaatcacctgactaaaaaatgagcaagtaacctgaatagacatttctccaaagaagatatagaaatgagtattcagatttatagacaggaaatagaatggtggtttccaggggctgggggcaggaagcaatggggaattactgtggttttttcttttttgttccttttgagatggagtctcgctctgttgcccaggctggagtgcagtggtgtgatctcgatctcagctcactgcaacctccgcctcccaggttcaagcaattctgctgcctcagcctcccaagtagctgggattacaggtgtgcaccaccacgcccagctaatttttgtatttttagtagagatggggttttaccatgttggccaggctggtctcgaactcctggcctcaggtgatccgcctgccttggcctcccaaagtgttgagattacaggtgtgagccaccatgcctggtggggattatcgttgaatagacatagagtttcagttttgcaagatgagaagagttctggagatggatggtggtgatggcagcagaacaacgtaaatgtatgtaatgccatggaagtatacatttaaatagagccaagatagtaaacttcatgtaatttgtattttaccactatttaaaaaatcaaaaataagtacaatttgtaaaagaagaaacttgaacaaattttattaatttccttgggaaaatgtttctataatcctaactgcaactgccagttatctcccctttatagacaaaaaacaagcaaaaaaaaaaaaaaaaaaaaaaaaaccacaaaatacttcaagctttccaatgacacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcagaagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattacaggcgtgagccactgcgcctgaagttttacatttaacaagtttttgggcttgcaatcatttcttggtctgagccacatgtgttaaccaccattgtccctgaatgggccctctccctcccctaaatagctcaaaacatcagtctaaggcagtgattctcacacaatagtgtgcatctcattgtcatgtggaaggcttgttaacacagagactgctgagtcccacttagtgcttttgattcagtgggtgtaaggtgggcctgagaatttggcatttctaataagaagttagaaaatgttgagttcctagaactcatcaagctttttatttctttatttatttttattttatttttcagacagggcctctttctgtcgcccaggctggagtgcagcagtgcgatcatagctcactgcagcctcaaactcctgggctcaagcgatcctcctgcttcagcctcccaagttagccaggactacaagcacacaccactggcattgatatatatatatttttaagttagttttttctttttcttttttttttttttttttgcgagatgggatctctctatgttttccaggctggtctcaaactcctgggctcaagtgatcctcccacttcggcctcccaaagtgttgggattacaagcatgagccaccgtgcctggcccaagcttactcttgacttagaaccttcagatacactgttccctctgcttggagttttatatatccactttatgcctagctggctcttattcatatacttctgatctcagttagatgtgacttttaaagatagcctattcccagttggttgccctacgtaaagtgtctcctttttccttgactctcaacaccctattttccttctgaaccctgatcacaatttgcaagtacatatatatttgcctattcatttattcattgtctgttccttcccaagaccagaaaatttattaaggcaatcctacattattgtttttcaccagtatatgccaagccatagtacatgataatccctcaatacatttttattaaagaacaagcagtcaagagaattaggcacttctgtactaattactaatacttcagaccaatagctattgtcagactgcttcgtaaacagtttctcacagaaacctgacatagagttcctaaataagagaaagctacccattttccttatcccatatctgaattatttatatctatcacttgatttatattggagcatttgctaatttctgaagcatctctcattctttgggcaagaatataacatttcagtttttggtctctaccagggatttttaaaataaaaatggagtgagtgggaaaaaaagaggaagtagcctattcaaggaaaatatattctgcttggtggtggtggcacaagttagtgcatcttttggagggcattttaacaacactgaataaaagcattaaaaatatttacatatgaaaagactagaagactacaaaccaactgaaatccagcctgggctctactaccaaattggttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcatttacaaatattttccacttgtgtagaaaagggatagtaacatgcatactttagggctgttacaaagatggatgagaagtttaggcatatttctccttcttttagttcacatatagtcacacaagttcctattcaggctagtccagggagactctgcaaagcagtaggtaataagttcatccatgagagagtcacagactaagatcctttgccgggtagctacctttttggagctgatttctcacatcgccccaggggcaacctctatcatgtagccttataaacgtctcctcgaactagacattggaaagtaggtacatgaaactgataaagaggaagcatagtgtggggaagaaagatatgtgttcagaacttgaacaaagggtaagaggtaggaaagtttaatgtgtgtctgaggaaaagcaaatagcctttaataacttaaaatatgaagtacagggcagctgtaaaagatgaatcatgggtgttttctgggatcaagattgtggtgggtcttgaatgaggtggcctttacaatgtagaatgaagatgtccacaaaacgggaatggcattttctcggcaactcttagatttaattactactcacttgaaaacacttactttatatccactagatactgtgcccacatatatgtgtgtgtgtgtgtgtgtgtgtgtgtgtgtgtgtgtgtgtatatatatatatattatatacctatcatccactggaaaaatggaagtctcaacacactcacaatcattagcagaggtacacaatttaatgggtcattaaaaaaaatgcaatccatattatgagaagttgagtcataggggtttggaaggtgcagagaaagatgctgatggaggggaagagagacctcctgagtagataaggtgactgaaatcattcacagaggggaacactagaagaggcatgttcctctggacatgaaatagtcacctggaaaatctcaagtagatcagtataacttgtggtcattgtggaaaggagaagagacacagagtgtttgtatgcagagacaagaagtaacaatggccagaaataagctggtggcaaatggagcaaattatttgcaaaataatttttaagggtcacgctatctaaaagatagcattttgccctatgcttttgcacaaatttgtttattcatttattccaaaaactattattgggtacctattatatgccagggaatgttctaggcactggaaatacagcgtaagatagaccaagtctctgtaatcatgcagcttaaggctaatggatatcatttcatttaaatgatgactattaataactaggcttataaagaagcaaattccaagccaaaatatatcatggctataaaatacaatttttgaccaagaaaatgcaggacaaagtataatattgcagatagcagtctcaaagagattctgttttcacttattaaagcaaattaagctacctctgcatgtctgaataatgattaatagaggaatctagaattgtgagttacccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagcctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctcaccataaaattgatattttcaagatattattctgatttttatgatcacatcttaaggtaatatctaaattcatatcctgtaatagtctgttatgacaactgctatcatgataatgtccagttaagtacatgcaaatgatgaataaattactacttacacaaatgagtctaagtgtcaagctgtctaaacaacgttctcagatgtgatttccaaaaaaaaaaaaaaaaaaaaatcactcattggccaaatctaccctttagaaaaagtgattgatattcaactaacagatatatttaatagtaatagacttttttctttttcaaaataggagtatgatttagtgccctcaaaaatctgtgggggtgatgctgcattgattatctaaaggagaatacaatttcagtaggaaaaagagttcaaaactctttttaaaataatcttttcactaataattcagtaattttagattcaaagtgggtcagatttcaccaagacccctcttgcatacaacaatcaaccccaaaccctaggcagttttataggagaaacgactttgcaaatgtcttccttcaacctttatacaaaaaaaaaattgagatggttccaaaggtaatattttattcacagcataagccaacggagtaatttatgctcatttgtttagcctgtatttcttttaaccttatgctttattggatgcacaaaagtcaccctgatattggataacctttgtggagattctagtatattgggtttgtgaaagtctaaaacaatggaccattctctcccttgctttagccccatccctgctagaaacatgtgaagaccaaaaaccaactggcaagcagaaggtgaagcaggtaaaatgccgttgcatacagtctgcttgcttgggggcagataagaaacttaaatcacaggtcagttaaatgggtattatttaataagacctaataggctttaggttcacaacaatggatagatctcaaaatgggttacaatgttttaagagtaggaaaaaagtaaatgaaaggaaactcagcagtagtttatcattggttctaaaaaaaacacatcaatgtattgccaaagactctcattcacttttgtttctacttaattcctgtacttcggcatatattgccaataaattgacttcactctgttcactaacttgcttatgccgtgttaagatcatgatgatagaatgtgaatatttgatagggaaaagttctaaatgagtcatttgagtctataatgatgcataatcccggaaaaccaaacttctaaaaataagtgtgtttcgaaacaggactggcaggttcttaactttatgaagaaaaaaaattaccataaaaatcaattccttaaaagaaaatagaaatctgtcttagtgttagatcctccagcctcattctggttaagagaatttggcgtttcagggctgagcacactgtggaaacttaataaatattgaggtttacaaacaaaaagcataacaatgatatgtggaccaattttcaacaacactgaaaatcaatgtgcccttactctgcctaattcagttaactcaattatttaatgtacacttgatttgagtgggtttgaccatagctatttccattttccattgaacattaatcaaattgcttctaatgtaaaatttcattttttctcatccttctcctctcccagattctaggataagggaaaagtttaagtttcatgtctcttgtttaaagttaaaagcaaattttaagacatctgtttccattagtttatcccataattctcttttcatataccactcaccctataccacaaccatgaactttttcacagatatttaatacattgttttttgcaccattttgggaaaaatcctccttcctcaaccacttcagctaagactcttttctactttctcccagttgatcccacatcatctctatttcatctctatttcacctcatctctatttctatacacaaaaatataccctccccctgaacacagagcctcaaggggtggacaaagtaagttataaaatgtaggcactcctggagaagctgttagctattcatatctagcaagtagattttacttaaaaagtgttgactgatcccaactatttttaatatcctagattcagaaactctataaagtactattttatcatcagtatgtttggtagaaaagtgtaaggagaatttttaaatgtaattgtttttattggtaaatgcaaaaaatatttacacaaagtgaaaagttatgtgactaaatatatatatagtttgagacaaggtcttgctttgtcactcagcctggagtacagtggagtgaacagggcacactgcagcctcaacctcctgtgctcaaacagtcctcctgccccagcctttcgggtagctgggactacagacacatgccaccacacctggttaatttttgtattttttgtccaaacgaggtttcactatgttgtccaggctggtcttaaactcctgagctcatgcaacccacccacctcggcctcccaaagtgctgggattacaggcgtgagccaccacggccggccatgactaaatatttttaacgttaaaaattaatactgggaaggcaagttatgctgttggtcatctgaagcaaccccaaaattgtaccagtgtcattaaaataccaacaggaaaaaatgaaataaaccaccgtcaaagtcttccacaagtgagatttagaaaagaagccatttattcatttcaaggttcctaagcgaaacaatgctccctatgatgctcccatatctaaactattaatcaatccaacaagaggctgtgtgcctgcattcatttttaaactaaatcttctggatattgataaatataaaagaaataataaatgatatatttattacttgtaattgaagaaacgctaacactacacaaaatatgtcttcaggtacatacacagtagctttactatggaatattggttctcagaatgtatctctgaaccagcagcatcatgaacacctgggaacaagttgggacttcttagccttgccccagacattttgaatcaggaactctggggaaggggttcaccaacctgagtttctacaagccctccaggtgattctgatgtatgctgaggtgagaaccattgccactgaaaattcttgacattctcaatgatgtctggacatgtctgaatgcctagacatttacagattccataactataaagccaaactcacttatgaggccattttcttactaatagtgatcactttcttagactttttcattcattaactcttctcttccatcactaattctgatgaacagctatcaagctattcatggtagggtggagggtaggtggattttccataaagaaacaaaattctcattatttataaagaattactgtacatgcaaaaacaaaacagcattaaaaaaagccaagttgaatatgaagagtgagtggattactaggtttacttattagttgcaggggacactttacctaacctgggcatccatccttcagctgctgtgatggttgactattaatgtcttatagctacctgccttctccacatgtgacctctgcttatgggagccccctagcccaggaagtaacccatatcccaggagtggaccacagccagtggtgtgctgcagcagagcccaagagccaattgtgtgcatctcctcccaattccatactcagtggcattatgtcggtagctggagatcagtggtagagggagtatttacaccacgaaaactggttttgatacacaccaggattcatcccacctcagagctagtcgacaaatatttgccagcacttcagtgacacagacaatgactggtataaaggcacaactccggctcggtgttgtggcttacgcctgtaatcccagcactttgggaggctgaggtgggcagatcacctgaggtcaggagttcaagaccagcctgactaacatggtgaaaccccatctctactaaaaacacaaaaattagccaggcgtggcggtgcatgcctgtaatcccagctactcaggaggctgaggcaggagaatcacttgaacctgggaggcggaggttgcagtgagctgagattgcactccagcctgggcaacaagagcgaaactccatctcaaaaaaataaaataaaataaagagtacaactccacagcgaggtttctgctcgagggcttgctctctctctggatcagacacaatgtgaggtttcacctgaaatggcatacttgctgggctctttcttctcctgtattgtttccctaactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcaaaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctctcggaagatgcttttaaatagaaaaacctgcagtaagtgtaaactataactaaaaatattattttaacatgaaaaaatcttattatgaaaaagttctttcttaggccccattaaaatgagagagacattagtatcacagacacaactgttcccataatacccagaaaactgatttaccaagaaaaattattcaatgccattacttaacttagttaatttcaggttgtgtaaggcataatactggtgtcaatgctaactgttaaattttgaaaattgtaattgtcaagcatgacaggaagaagcgaactccttgggttatttgatcttaaagcatttcctgttttactgaacggtaggagagtaacagaattgtgaactttattcttgtcacaactttggtagatgtcaaaaaataattaaaaatatatattggctgtgtgattccattttcttaggaaatatggaatttcagttaaataaataactcacattttagcactgtttctagttaatgtggtacatgcacatgtatacacaagctaatacaaattcttgctccctcagcttggtgctaaataataatattcccaggaaaactaagatgccatctatacaactctcaatataatttttgtttttgaaataaattaaatgttcacactctataatgagatcagacttctctgggtataggtttcaatcatatcatgaattaatgaatgagtgcatttgtatatcctctaatactgagagtatattacttaagttttttgaataatcttttattacccgagactcttgaggaatagtatttctagttattacccaccacaaacaaagctttcagaaaatcctagcaaacaggattggcatattataggatcagatgttgatatggttgttttcaaatagtaggaaggatggtattatttggagaaatttttattatctgattaaacacttcttgagtagaatcagatgaactcattagctgaacattttgattacccgtgttctcctaaatatcccatgaccagaagagtagctgtacaactctgatttaatccaataacaataataaccaattctagctccttcttttatcacagtccatcaaaataacacaaagaagtccaaattaaaataagttcaatgacaaaaagaacatgttccttttccaactgttctaaagccttttcctgtctttaagcaaagttcattcagtcattatctcatctatgaaagtaaaagcagaaggatgtttcccttattaaataaatggctttatgctttcgatgtggaaggcatttcataacagtcaaaaaaggaagcgttttgaatgccatcaactcatttcctcccacccactgttttaaatcgtttgtttggttccaatgtatactacacttacataagttgtttatgaagagccaaattaatagtctttgcaattgtttttgttggaatttggagagctgacaagtgaattagtagaaaatggcaattctacatgaattagcttttaagtctccctaagaggctgatgcagaacttaataagagacttattaggagaagtaggacaacttaattcagattgattatagacttcggtgaagacagctggggttcaaatgaaactgaaaaagaacttatatgcacttcaaagtatgctaagcagatgtctgaaacaattactccgctctgccttttcagaagtttcaaaggcgggatgggaatagcatggtaaacgaaggttctgtttgcctaagtcgaggtaggggcttttaaaacacacacagcgctatctaaaatcagatgctttggggaaagaaagtgatttgacattgctgtcctaagtaatttgcttttagctttataaacaaagcaggagatgagagggaatacatggtaactaagtaataagctctcctggcaacactaacttacaattaatttcacattgaataaataatttggtcaggattttttttttattattattatactttaagttctgggatacatgtgcagaacgtgcaggtttgttacataggtatacacatgccatggtggtttgctgcacccatcaacctgtcatctacattaggtatttctcttactgctatccctcccctaacctcccacccctcgacaggccccggtgtgtgatgttcccgtccctgtgtccatgggctctcgttgttcaactcccacttacgagtgagaacatgcggtgcctggttttctgttcctgtgttagtttgctgagattgatggcttccagcttcatccatgtccctgccaaggacatgaactcatcctttcttatggctgcatagtattccatggtgtatctgtgccacgttttctttatccagtctatcattgatgagcatttgggttggttccaagtctttgctattgtgaacagtgctgcaacaaacatacatgtgcatgtgtctttatagtagaatgatttataatcctttgggtatataaccagtaatgggattgctggatcaaatggtacttctggttctagatccttgaggaattgccacactgtcttccacaatggttgaactaatttacactcccaccaacagtgtaaaagcacacctatttctccacatcttccccagcacctgatgtttcctgactttttaatgatcgccattgtaactggtgtgttttgatttgcatttctctaatcaccagtgatgatgagctttttttcatgtttgttggccgcataaatgtcttactttgagaagtgtctgttcatatcctttgcccaatttttgattaggttttttcttgtaaatttgtttaagttccttgtagattctggatatcagccctttgtcagatgaatagatggcaaacattttctcccattctgtaggttgcttgttcactctgatgatagtttcttttgctgtgcagaagctctttagtttaattagattccatttgtcaattttggcttttgttgccattgcttttggtgttttagtcgtgaagtctttgcccatgcctatatcctgaatggtattgcctaggttttcttctagggtttttatggttttaggttttatgtttaagtcttgagttaatttttgtataaggtgtaaggaaggggtccagtttcagttttctgtagatggctagccggtttacccagcaccatttactgaatagggaatcctttctccattgcttgtttttgtcaggtttgtcaaagatcagatggttgtagatgtgtggcattatttctgaggcctctgttccattggtctatatatctgttttggtaccaataccatactgttttggttactgaagccttgtagtatagtttgaagtcaggtagcatgatgcctccagctttgttctttttgcttaggattgacttggctatgtgggctcttttttggttccatatgaaatttaaagtagtttttctaattatgtgaagaaagtcaatggtagcttgatggagactgcattgaatctataaattactttggacagtatggccattttcacgatattgattcttcctatccatgagcatggaatgttcttccatttgtttgtggtgtcctctctcatttccttgagcagtggtttgtagttctccttgaagaggtctttcacatcccttctaagttgtattcctaggtattttattctctttgaagcaattgtgaatgggaattcactcatgatttggcactctctttgtctattattggcgtataggaatgcttactatttttccacattgattttgtatcctgagactttgctgaagttgcttatcagcttaagaagattttgggttgagacgatggggttttctaaatatacaatcatgtcagctgcaaacagagacaatctgacttcctctcttcctatttgaataccctttatttctttcccttgcctgattgtcctggccaaaacttccaatattatgttgaatacgagtggtgggagagggcatccttgtcttgtgccggtttttaaagggagtgcttccagcttttgcccattcagtatgataatggctgtgggtttgtcataagtagctcttattattttgagatacgttccatcagtacctaatttattgagagtttttagcatgaaggggtgttgaattttattgaaggccttttccgcttctattgagataatcatgtggtttttgtcattggttctgtttaagtgatggattatgtttattgatttctgtatgttgaaccagcctggcatcccagggatgaagccaacttgatcatgctggataagctttttcatgtgctgctggattcggtttgccagtattttattgaggattttcgcattgatgttcatcagggatattggcctgaaattttctttgtctgttgtgtctctgccaggttttggtatcaggatgatgctggcctcataaaaagagttagggaggagtccctcttttcctattgtttagaatagtttcagaaggaatggtaccagctcctctttgtacctctggtagaattcagctgtgaatccatctgttcctgggctttttttggttggtaggctattaattactgcctcaatttcagaactcgttattggtctattcagggattcgatttcttcctggtttagtcttgggagggtgtatgtgtccagaaattaatcaatttcttctagattttctagtttatttgcgtagaggtgtttatagtattctctgatggtagtttgtatttctgtgggatgagagctaatatcccctttatcattttttcttgtgtctgtctgattcttctctcttttcttctttattagtctggctagcagtctatctattttgttaatcttttcaaaaaaccagcccctggcttcattgattttttgaaggatttctcatgtctctatctccttcagttctgctctgatcgtagttatttcttctcttctgctagctttggaatttgtttgctcttgcttctctacttcttttaattgtgatgttaaggtgtcaattttagatatttcctgctttctcctgtggggattttaatgctgtaaatttccctctaaatactgctttagctgtgtcccagagattctggtccgttgtgtatttattctcattggtttgaaagaacttattcatttctgccttaatttccttatttatccagcagtcattcaggagcaggttgctcagtttccatgtagttgtgtggttttgagtgagtttcttaatcctgagttctaatttgattgtactgtggtctgagagactcttatgatttctgtttttttgcatttgctgaggagtgttttacttccaattatgtggtcaattttataataagtgtgatgtggtgctgagaataatgtatattctgttgatttggggtggggagttctgtagatgtctattaagtccacttggtccagagctgagtttaagtcctgaatatccttgttaattttctgtttcgttgatccgtctaatattgacagtggggtgttaaaatctcccactattattgtatgggcatctatgtctctttgtaggtctctaagaacttactttatgaatccgggtgctcctatattgggtgcatatatatttaggatagttagctcttcttgttgcattgatcactttaccattatgtaataccattttttttgtcctttttgatctttattggtttaaagtctgttttgtctgagactaggattgcaacccctgctttttttttctttccatttgctgcttggtaaatattcatcgatccctttattttgagcctatgtgtgtctctgcacatgaggtgggtcttctgaatacagcacactgatgggtcttgagtctttatccaatttgccagtctgtgtcttttaattggggcatttagcctgtttacatttaaggttaatattgttatgtgtgaatttgatcctgtcattatgatgctagctggttactttgcccgttagttgatgcagtttcttcatagtgtgatggtctttacaatttgttatgtttttaccatggctggtaccagtttttcctttccatatttagtgcttccttcattagaagctcttgtaaggcaggcctggtggtgacaaaatctctcagcatttgcttgtctgtaaaggattttatttctactttgcttatgaagcttagtttggctggatatgaaattctgggttgaaaattcttttctttaagaatgttgaatattggcccccactctcttctggcttgtagggtttctgccaaatgatccgctgttagtctgatgggctttcctttggggtagcctgacctttctctctggctgcccttaacattttttccttcatttcaaccttggtgaatccgattattatgtgtcttgggttgctcttctcaaggagtatctttgtggtgttctccatatttcctgaatttgaatgttggcctgtcttgctaggttggggaagttctcctggataataacctgaagagtgttttccaacttggttccattctccccatcactttcaggtacaccaatcaaatgtaggtttggtcttttcacatcgtcccatatttcttgaaggctttgtttgttccttttcattcttttttcagtaatcttctcttcatgctttatttcattaagttgatcttcagtctctgatatcctttcttttgcttggtcgatttggctattgatacttgtgtatgcttcacaaagttctcgtgctgtgtttctcagctccttcaggtcatttatgttcctctctaaactggttattctagttagcaattcctctaaccttttttttaaggttcttagcttccttgcattgggttagaacacgctcctttagctcgtaagagtttgttattacccaccttctgaagcctacttccgtcaattcgtcaaactcattctccatccagttttgttcccttgctggagaggagttgtgatcatttggaggagaagaggcgttccggtttttggaattttcaggctttttgtgctggtttttcctcatcttcgtggatttatctacctttggtctttgatgttggtgaccttcagatggggtttttgtgtggacgtcctttttgttgatgttgatgctagcagtcaggaaccctctgctgcaggtctgctggaatttgctggaggtccactccagaccctgtttgcctgagtatcaccagcagaagctgcagaacagcaaagattgctgtctgttccttcctctggaagcttcatcccagaggggcacctgccagatgccagccagagctctcctgtatgagggtgtctgtcaacccctgctgggaggtgtctcccagtcaggaggcacgggggtcaggaccccacttgagaaggcagtctgtcccttagcagagctcgagtgctgtgctgggagatctgctgctctcttcagagccagcaggcaggaacgtttaagtctgctgatgctgcacccacagctgccccttccccgtggtgctctgtcccagggagatgggagttttatctataagcccctgactggggctgctgcctttctttcagagatgccctgcccagagagaaggaatctagagaggcaatctggctacagtggctttgccgagctgcggtgagctccgcccagttagaacttcttgacggctttgtttacactgtgaggggaaaactgcctactcaagcttcagtaatggcaggtgcccctccccacactaagcttgagtatcccaggtccacttcagactgctgtgctggcagcgagaatttcaagccagtggatcttagctggctgggctccgttgggggtgggatccactgagctagaccacttggctccctgacttcagtcccctttccaggggagtgaatggttctatctcgctggtgttccaggtgacgctgggatatgaaaaaaacgcctgcagctagctcggtgtctgcccaaacagctgcccaattttgtgcttgaaacccagggccctggtggcgtaggcacccgagggaatctcctggtctgcatgttgcggaggctgtgggaaaagcatagtgtctgggctggaatgctccgttcctcagggcacagtccctcacggcttctgttggctaggggagggaattccctgaccccttgtgcttccggggtgaggcgacatcccaccgtgcttctgcgccctctgtgggctgcacccactgtctaaccagtcccagtgagatgagccgggtactgcagttggaaatgcagaaatcacccaccttctgtgttgatctcactaggggctgcgcacctgagctgttcctattcagccatcttgccagccacttctttggtcaggattttaaagatgaataattcctgctttagtttctaagctgtattaaaccctagatattctattgaaaagctactgaaagtaaatcaatatatatgaattcacataatccataatcttacaatagcataaaatccttaatacagtactggtttagaaacccagtaacatctcttatcaccagtacataaacattctattaaaaatataccgtacttataaagtatggagtgacactcgctataatatggcctttgatagacatattttcagatattaaaggccaaatcatatgcttttaaacattgcaattgcatgctttgtaaactagataaaaccctggttactccaaataacaggaattagcttcatatttaacccagatttatgaaggattaaatattttttctttgttttttcttctccatcaaaggcttacttaatacacatagcatttttacaacaacaacaatgaaagcctccacacggcaattcatttgtagttctttaacaatgcacaaaacattaataaattttcctcttcctactataggcagtataccttattcattatgaagatatcacaagtttattcagagttgggagagcttacatgttttgaatgatttttaggatcgccctgttcatgttggttctatctgctcattcatcccctaattctataagaaaagataagttttccttacataactcatatataagaaatcaagtaaggttgacttgactcatataaatgggaagcataacaaaattaatacaataagaagaaaactttagaaccaaggttaagaagagaaaagcaataagggaagatagttgcatgaacatggttgcaagtatcttgcttgccaaagtgaagatgaaattctaatacattatatcacatttcacattatctattcagaggaaatatgcttggcttcctcaatgtcaaattctaacatagcgtttctttgacaaatttctcaaaaaaacccaaagccacagggactgaggatggtaagcctaaaaaggtggatttgccagttttcttcttaaaactttagatgtgaatgctgaagataaataaggatggcatcgtcacttcatcataatttctagcctactacacacatcattaaatcaatctcaatttgaatgccaaaaaaggtttaatcaaaacatttcattgtaggaactttaaagaaaaaactcatagaatccctgccctgacttttcacagtaagaaatgcaagttaaaagtttgacaaaaatgcgatatgcataactacatagatgcgacagatttgcatattccaagatggcagcctgggagagttatttacagtgtatgaaaaactgtgttcagagtcaacaggtaaactaagaacagtgaaatattcctggctcaagaaggacataccacttttggtacagagaaactatggtttatagtctgggcgcagtggctcacgcctgtaatcccagcactttgggaggccaaggtgaacggatcacctgaggtcagaagttcgagaccagcctggccaacgtggtgaaaccccatctctactaaaaaatccaaaaaaaaaaaaaaaattagccaggcgtggtggcacatgtctgtaatcccagctactcaggaggctgaggcagagaattgcttgaacccaggaggcggaggttgcagtgagccgagacagcaccactgcactccagcctgggtgacagagtgagactgtctcaaaaaaaaaaaaattaaaaaaagagaaaccatggtttattaaaacaaaaacaaaacattaaaaaacagcaatctggccgggagcggtggctcacgcctgtaatcccagcactttgggaggccaaggtgggcggatcacgagatcaagagatcaagaccatcctggccaacatggtgaaaccccgtctctactaaaattacaaaaatcagctgggcgtggtggtgcgcgcctgtagtcccagctactcaggaggctgaggcaggagaattgcttgaacccaggaggttcagcgagccgagatctcaccactgcactccagcctggtgacagagtgagactctgtctcaaaaaaaaaaaaaaaaagaaaacaacaatccacaaaccttttcaccttgggattgtcctgaagaacaaaaatcttgtatccagactacaggtttaaaagttattctactttattaaagcctttatatattccacttacagatctatgtggaacacctagtaattcaaaaagttattcctattccccattacaaggaaggtagaatatttgtctagtcaaataagcactggtgctattttcagtaaagtgaaaagtcatgatcttgcccttaaaatatttgataagcagtataaatcatgaattttaaaagtaaagaagcatttaaaacttaaatttgattctactgttttttcctatggaagctatgtttggaaggctgagattctcttagtgagcaatatagtcaatattaatattgtgtttccatttattaatttaccatgttcaccacccgcagatgatcagctagcaataatgccatttccataaaggccagggacttagtcattgttgtttcacccattctttaaatccaaaagccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttcaagtacacttctactttttttctgaaataaattttagttaataaaactcattctttgtaaactactacccccaaagcttcagagtttcaaacccagtgtcaataagatgcagtggagaaaaatgatttatttccactgcaaaattaaagaagagctaccgaagggagataaatatatatgaattcatgtaattcatagtttgaaacacgcataaaatacaacacagattcaaaagcccaatcacatctactattaccagtacataaaaattcagataagtaccataacttaagtgtatatatgtctgagaaagatagatgtgctgggttataaatataatttttcgaaaggtatgtttaatgtttatatgttttgctatcattgggatcagaatgagagttttaccaatcagggtatggaaaatgaagtttgtcttaagaccaagaacagataagacagggaaactaaaaggaataccgcaaatagggttgggtgaaggccagctgatacttgaactgttatgcttttagttatttttaattattaaattatgctgtacacattctcttctccatccatactcagtatcttacaaatgcacctgtgtgacaagtatggctaaaaatgaatcccttatgtctgctctacagcctatctattgagcaatttaattgacatattaactaatttagttccactgggacattttcctaacttatttctcatttttggagaagtctgtcaaaaaattagtccctatatttttgaataaaatcaacatatttaatgcttttaaaatactaggtaatacatttcaaaacccttagttttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggccctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttgggggttgtagacactcaggaaagacaacaaagataggtaacattttggctggtccttgagggctgaaggagaattcgccaagtagacaacgtagggggatccagacagagagaacagcatttgcaaaggcagatatatctatatctatatctatgtgtatatatatgtgtatatctatgtatatatgtatatatactatgtatatatctaactatgtatgtgtgtgtgtgtatatatatatatatatatatatacacacacacacacacatactttacagacacacacattcaatacactctgcccatatcacccctttttcccaaatatgccatcacatatatatatatatcatatgggcagagtgtattaaatggtctggagaataggagctatggctgagaaggtaagtcaaggctaggaagaaaagggccacgtaatctccttattcattggatttcattctctaggcaagtattctcccgcaaggagtttggattggaattggaagaagctgggtaatgcaggaacatcagcaaagaaaccattcatccatccattaattcaccaaatgtttaaaatgcagtatctgagatatgccaggcacacagaggggtgaatgggatttaaagatgtatactgttatcatctaagtaaaagatgctggggattaaaaaggacattggttaaaagaggagagaaaacacaaaagagctattctgaggtaacatgagccatcatgtgccatcagtgaaaatgcagaagggtttaaggatgaacctaaagtttctagcctggaaaatttgttggatgatgattcattaactgaaataggaaacaggaaaaaaaaggtcagataagaggggacagaagtagggaaatggaaaacaggagaacaaatgaacttggtttcagaatagttgcatttgtgatcgtaatgccacatggattcagagatcagaagagagatgcggactagagatgtagatacatcaccatccaggccatctcaaacagggagggtttaaacaatcaaaagagaattaggctaaggttagaaacttgggcacaacagtatttgaggggtggctaggagaagaatctagaaaaatataggaagaagaacatggatggaacagttccatgaaagccaaggaagaggacaacttctagaatgaggatgctgagatgctggcaaacatgctgagtgcatgagggaatttaacttcttttgaattttaatctaggaggatttttgtgattttgacaatagatgagtagttgctgatttcaaaatgatactcctaaatatgtatttttttctacagaatatatttgccatctttgtgccacaagggaatttaactttggtcttatagacagtggtcttccaaatatataatgattttccctcatttctgcagtgggccaatgaaacttgaaactgtattacaaatgttgccttccaagggaagggcaacacattaacagccttatttcaccaaaccataacttacccaagtcatgtaatttggttagcaaaagggccaacacctagactcctggcttttgattaagtgttttatttttctgtattctgatactaagtaacacaagcaatacaccaatacacacacacacacacacacacacacacacacacatcagactttagtacaatcacttaatatcaaagtcaaagtgatttcttgccctgtaactgttttaatatttcatttcatataactgaagacagacaaataattagatcactgtcttctcttggagaaaataccatgtgaatgaagactgaatttgtgaaagacggactgatttctctagctttaactttgtgggaagataacactgcactcaagttcagattagaagctcttttgagtctctcaaagggccctgaagcaaagaagtagacggtaccttgactttctcgaggtgatcttggagagagtcaatgaggagatcgcccacgggctgccaggatcccttgatcacctcagcttggcgcagcttgaggtccagctcatccgtggcctcttgaagttcccggagtctttcaagggtctcatctatttttctctgccagtcagcggagtgcaggttcaatttttcccactcagtattgacctcctcagcctgctttcgtagaagccgagtgacattctgggctctctcctcaggaggcagctctaaattggcaatatgacaaggttttaggccacattctttttttttaaacattgtcaaaaaggtcatactggaagaaagaaagagtacagttgaacaagagggtaacctactgattaacggcttttttatactttggcataaattttgatacagcccagaacatctaaagtatatcttcctgagtttctaccttatatcaatccgacaatttaagattcacttaagctattgaggagaaaaacgttaggatgcataccacaagctctaatttacttcaggcaggctcttaaatggaaaattaacttgtagtctttgcaacaatagaattcctcctcacagataactccctttgtttattattttctaaatgttccaataactgattgctaatctcttttgatgtttatttatgaatgcacaaactgatttatgcatggtagtttatgagtccttatttttttttcagcatctatgtttaatttgaattgattctatttaaccaagaaaatatgagagctatccagaccctggcagcaagaatggatgggctgctccgtcaccactgatccttctatcaatatgttattatagttccacattcaattacctctgggctcctggtagagtttctctagtccttccaaaggctgctctgtcagaaatattcgtacagtctcaagagtactcatgattacaggttctttagttttcaattccctcttgaaggcctgtgaaatgagatgaaaagaagtgcttatttggcttgtggcattcttctcaaaattaatcctgggtgctcagaacttgtttatgaaactcccaggtcaatttctatctcttttatttatacactgatggttataaaatgattttttttaaaggctatatgggtctatctgttaatgaggaaagcgctgtgtttgtaaagctattctggggagatggggggagcattctggatagttaatgccctctcattgagataagagtgctttgtttatgtaacctgacagccatacttcaaatctacagctaaagtttcaaggtatatattgcaaaactctagcatggctaatgaggacttaaacataccccaaatagtggatatccagaacataatgggaagccttaagggccatttgcaggaccttaggctatattaaagtatacaatgaatccaactgacaatcaccagttaattctgtcaaaatgtctgacaaggtataaaataggtaagctaagagaaaagtctcaatacttttgaaaaatagtcattacatcatccattgtgacctctttgagaatagtagaaatgttttgagctattatggatgtaggaattgcggacactagtttctataaatgaacagatctagaattaatctttaatctgtaatcttcctttatccaggggatcaagagaaaaacaaaatgaatagtttctgccttcaaaaagtttctagatccaaagaagggagaaaattaacactagaagcagagtgaaaacagtaagttcacacataatcgagtgctaaaaggatcgtgaggtataccgtgagcctagaataacctaacggatactctgacaccattgaagagagttattgacccagattctttgatctcagaagtgagggtattaataaaagtattaagtgcatgctacataaatgctaatataactgtttaacaataacagtaatatttgccctgatctagggcttaatttttgtaacttttttcaactctgtcttttagcaatgttgcctgctgaatttaagccctgttctttcactggggaaaaacaaattagcagtattcttccttgaatttcagatatgccattatgttacagaagtgttccagagctgtattgtatgacacatttattaataaaatcttagcggtgttcaccattcaaaagaatcctgagtctgatactttgcaaaatgattcatcatccacagctatttacaattcaatagagaaagggaaggcgtttgaaccaaaatactggagttctgtaagtagaatattaggattcagcctacagatagggaagtactttctgaataatgggatatttctgtaccctaaaatcatgctagatacgtgagttatttactctgcttacatataaagctgattctcctgatatttcacttgaaatctccatgtttgtgtgtgtgtgtgtgtgtgtgtgtgtgtgtgtgtgtgtgtgttcagttgttgtattcttgtgttttttttcatacaattaagtttcccaaattcaagtaaattatcattttgcctagtttctctgtttggacctgaagggaggcaattaatactgacattactaattataaaaataataatggctccctctattgaactaccatgtgtcagtggttgtacctgaaactggaaatacaaagttgaatgcaaaacagccctttctatttaggaatatttaacatataatagaagagtcagacacgtaaataatttcaatacaatgtagacagtgctatagacttgcgcaatatggggaagaaaatcgggaaaagcttccaggagaagctagtaatcacatagaattcaaaagcatgaacatgacttattcaaggaagagtatgctagagaacattccaagaagaggaaaatgcaagtgcagagtcataggacatagtgcagtatggtatgtatcggaatctcaagcaggccagtgtttctagagcataaagaacaaggagagggcatgtccaaagatgaaaaagacactattgctatctggaaatacattagatttttaaaccagaatttgaagctctgcctctctatgatcacatatggtccactaagaggcttaggtgttgccttgaaggtaatcaggaacctttgaacggttttaaccaagggagtggcacaggaatatgtgtgcttcaaatagatcttcctgatataaatacagagtatgtatttgagaagaacagaaatggaatcagagagataatgaggcaattgtaagaattcagtgcaagattatgaggatttgactcagggcaatggtaccaggaaaaatgacagggataggatagggaaatgtctaaaaatctgaagtgtgaaaatttggtgactgaatagatgctggagagaagagagaaaaagaaacaagaatgacacttagtgtctaggttgagtagatgagcaaacgctgggtgcaattcaactaagtatgaggaaataaactttcctggatgtctcagttcacctacagaaagctctagcctcctgagaaacttcccacaccatggagattagatctgtagcaatttgtctagttcatttctctgatccaagagggtcaaacggttatagctcagggtaggttcctaagctgaactctatgttgttagaaagactggagtgggtatctttctaggtatttacatttcaaaaaatatgaagcccataccttggagacatttccagattgtaaaacatgagacacacagggctagctggtttctgcagaagctggaattaggactcaggcctgttatgtttccacagagaacctttcagaatgagagatggatagcagcctccttctcctttataagcagaaaaaatgatttttcctagtctcccacttatggagtacccagccactcaagtaggaaaatgtttcatcagcgttcatcatgttgccctaggggtaagtctttgggcaaaggaagggcacagcaacaatatttactgtaaggtaattaaatgaaatctgcctctgattcagaacccctcatgctcattcaggataaaattattgaagagtaatattaaaaatgcaacatgatggtgtgtgtgtgtgtgtgtggggggggtgttctgtgcatgggggacagagtaagggactgtgatatgctcagcttggaaagctaacattccttccacaaggaaataataaattctgaggtttgaggagaaaaaaaatacttaggagttattttctcattcagctaatatacgttgagtgcctacatatcaaagtttaatgggcaaacagaggaacaggatctcttgagagatagaaaaggaacaaataggtggagagattaggggaaatgaggagtgtagaaatttcaaggagagagtgagaattttgagaggaagagggtgaccaagtgagtccaatgaaacacagaagtaaagtaagatcagcattgcagagtgttcactagatgtgctgagagcaatttcagtggagggcagaagcctcagaagtaggcatagctgaggagtgagtggaagaaggagtaggtatttcaagtgaaaatcaaatgttcaattttctttttctgagaaggaaaagaggaagacacgacaggaggacagagaggataacaagacaaagggataagaagttctttttagcataggaatgatttgaacctagagtgaaagacggaagctagcagtagggtaaccaaccatcttggtttgtccagcattgagtttttcaggatgagagactttcgatgttaaaaccagaatagtttcaggaaaattggacagtctcaggaaaacgaggaaagttggtcaccctagatatatgttacgaccttgacagaaggtggagataattgttggaacaaggtctgtaaaataaggaaatggatcttttttttttttttttttttttttgagatggagtctcgctctgtcgcccaggctggagtgcagtggcgcaatctcggctcactgcaagctccacctcccaggttcatgccattctcctgcctcagcctcccgagtagctgggactacaggcgcccgccaccacgcccagctaattttttgtatttttagtagagacggggtttcaccgtgttagccaggatggtctccatctcccaacctcgtgatctgcccgccttggcctcccaaagtgctgggattacaggcgtgagccaccacgcccggccggaaatggatcttaaaggtctcatcaaacttaaaaacttaaggcactaaaaacttaaaaagtccaaggcactatttgatgatataattccattgttaaaactggacagtaaataattcaaagctaaggagcatccattgtgagagaccacgtgtttgcccatcgagttgttgccaaggacttagatccaccacagctgcacagttcatttcttaaatatgagtcattgaagattaaaatgaggccaaagaaaagacaaagaaagttctgttattacaaagacataagcaccattattttcacattgttgcctgaaattaagaaaagaaagtggatggaagagagggttaagtgattgtatctttagaatttcaaaagattcagattaaatacaaaaggataaaactcccacaaaaagagagaaatagttggttcaaggaggtcagaggttaaagaaaatggcaataattcttatcatgtgggaaaaactataaataacaatatgtaattttaaacatggttatatgtaagatcctctttaatttagtcacttaacaaacttcaagcaactactatgtatcagacactgttctaggcaatgaacatctgtggtctttgtagcatggagcttaaaacaaatggctttatgtagtaaaaaaaaagcaatgtagaatctgcattaaaataatggaaagccaatttttcagtatctaataactcaccataaactgcatgttgtagtataatttattgcattttaaaagaaagaaaaatgaagacttttttttaaaaaaagacaaacaagaatatttaatgtcaagagccttgattttgataagtgtcttgtctcccaaaaaggcctgtttgaaagaggtttgagaaaatatatactcatatatactgattttgtcatataaattttggttaatattttaaaccagagaagtcagttcctttatgtgatgatagaaaaggtatcagatatagatattttctcccatgtacatacagaatacgtatttacaatattcagatgttagcattcagatgttaagataattacttcctgaatcccttgaacagataaaattatctttgttaaaacacatcctcttccccatacctttcttttcacctttccaagacagccagacccaagggtccaaaatagtgatatgagagaattagaagcaatactaaagacgtagagcacctctatgaaaataaaatatgcaatttagaaaatgttaggaatactacacagatgtttgtccttgagcttcttaaggttcacaaaataaacttatatgaagtatgctactacactattatagcaatgataatctcaagataaatctatttattatgaaggttgaattatctggtagattgcacttaaaacaccataggtactggccaaccgggtgactgattgttgactcactaatttgttcattcaaaaaatatttattttgaacctattaggtacaaagttaggaaagatatagagacttaatctttgtcattaaggagccaatagtttggttgagtaggtatatttgtggtgtatacttttatattatgaatgtttcatccatgcaaattgagatacagataagttagggtttacctaaggccatcagttaattacacactttgaatctaaatcttgcaattctaaagtgaagctgaaagtgagtgataacaaaacataaaatctccctgacttagaataatttggaagccacataagtggaaaatcctaatggccatggaagaaatcagaaacttaaaaaattcctgaaagtaatagagaagaaccaagttattgattattattatttttatttatttatttatttatttttgagacggagtctcgctctgtcacccagtctggagtgcagtggcacgatctcggcttactgcaacctctgcctcctgggttcaagtgattctcctgcctcagcctcctgagtagatgggactacaggcacgcgccaccacaccctgctaattttttgtatttttagtagagacggggtttcactatgttgggcaagctggtctcaaactcctgacctcaggtgatccgtttgcctcggcctcgcaaagtgctgggattacaagtgtgagccaccacacctggccactgattatttttttctgtccctcttgcttcctgcttatattataaaaatatctaaataatgccataaatagaagtagctcagaaccacgtatggaggggatgaaaggtgagatattgatttgcttcatgagaggaacaagaggagaactctgggcataggtaatgacatgacagggagaaaagctatcttgctttctcctggggacagtggatttaggatcatattactatggatgtgagtaaaagcccgtgcttttcaaaacacagatgtctttcaatcatgtacagcttgcctggcgctgaattttacctgtattcatattgaaatggtaaatttgtgtttttcagaataaaatctgatggaatgactagaaatactacccatatttgtaagcagaacttcctagaatcatcctgggaggcaggctgaagtggtgaaaagagcactgttctgagtggcagaagccttgggcttcaagcctgggctgggccagaacctggctgcagtgatccagaaaaggtgataaactcttcctgctcctctgtgtcctcatttgtaaaatgtgggcatttgctaaaaccttatctaagttctaacatccagttctcatatactataatcaatttgttaagatcattaatcggccacaggcctgctctatggtggcagtttgagagtctctgctaagcatcgttattatcgatgcttaaaaaccatagccatagcttggcatatagtaaatgctcagtaaacattgttgactaagatacagaacacccagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaactgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttctttatttaaagagccaccatatttattgagtctcaaacacataagaatattttaccaaatgctcacttcgggacaagcaatgctcagttaacttaaaagcgaggtcttggaaaagggcaagcaatccaggatgtacatggcagggtggcaagaatattgcccccagtaatctaaagcaaattcataggggttcatggaagaaaaaaatttgaagaaagaggcaatggagcaaacaacagaaagagaggtttcccttaatagtcatttgagacagctagtattacagaagttatgaacatgggtatctgggctataaagaaaaggccataatcatcttttcttattgagataagaacacttaatatgaactttaccctgttaacacatttttttttttttttgagacggagtctcgctctgtcactcaggctggagtgcagtggtgcgcgatctcggctcactgcaagctccgtctcccaggttcacgccattctcctgcctcagcctcccgagtagctgggactacaggtgcctgctaccatgcccggctaattttttctttttttgtatttttagtagagatggggtttcaccgtgttagccaggatggtcttgatctccggacctcggttaacacatttttaagtgcacaaatcggtattgttaactataggcacaatgttatgcagcagacctctagaactttttcatcttgcataactgaaactttatatccattgagcaacaactcgcccttacaatgtatggcaaccatttttctactctctgcttctatgagtttgactaaataatcatctaaataagatgacaaaaagctccgccttattttcactccacttctgaataaaagtgaagataagggattgaagtatcagatacatccattcattgtttcagatagtcaacaacatgaacaacaatattaatttataaatgagattgaataaatttgatgtaaaattgaaaagtaaatgaacatatttcaggcctgaaattatgttttttttttaaaaatctaattatagtcaatgaaaaaacatttttgagtgtataaggggaaaatgtgtttaacaaactctgtgttgagatttatttttctggaagtctttgaaaacaaagattgtattctctgagatcaagggcacgggctagaatagtccagcctgcttgcaggtctgtgatactatggaggaatagtttactgcgcacacagcatcttgaacagctgtttgactcttaattctaaggctgggctgcttccaacaatcactggggaagttacttcctactgacaataatgttgttaagttctgagctgaccttgagagatcactggtgaaaactcaatctagttcccgtggccatttagggaattaggtcttaggtcattaagcctaaactttaagatttggaaattacttctgaaatgttagtagaaatgaatggattattagaaaaccctgtgacaaattaatttgtgtatgttctcaagatactgagccaaaatttgagattgtcaagtataagtggtaaataatatctgaatcataccctttgtgtctgtctatcaacataatccaaaaatggaaccctggttcattctaagcacatacactcaaacgtgatcattcccaagtctttctcagatggcaacatcattattttatttgttcaagccattgacctcagaattttccttgactctttgcttcctctcaaactccacattctatctatcttaagttctatcaattctaccctccaaatatatcttcgatcaaataattattcaccatacctatcatttccactctagtccaagtaatcatttccttctgagatgactccaccaccctccttttctgtgtcttcagtttcgctctttttatagtcaattctccatagcagcaagagtcaacttctaaacacataaatcagatcacatcatccctgctgagagccttccagtgatgtttccttacttccagtgatgtctctttactcacagaataaaatccacctccaaactatggcctgcaagaccattcattatctggcctttccctctttctagaacctatcactgtctactgatcttatttcccttgagatacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctagtttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccataggggcagagactcattttgttccctaacatatgcttaacatagagtaggctcttcataaaaaaagttcttgaaagaaccaataaattctaggaatctgagttatggtataatttttcctaaaataatgtttttgggggacaaaaggaagagcacagaaaaaaatcaaggggatcatttgtaattaaatgaataatgtgtgtaaaagtgctttgtcaaggcaaaacactatgcagatactgttttaaagagtatttgtcaggacatcaaaatattttgacaaagtgagagagaagactggtagagaagtcagtttgtaaattattcacatctcatcttgttacagtcattaaagcaaagcagcaattcctagatgactcagttcttcagttttgatgataaagctagttttcagaagacttagacttagttttcagaagactcaaatgcctagaaatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaagtaaaacaaaggaagtcagtttttaaaatatatctggaccagaataacacccactaattgaaaacgagtcagtctagtgaggcaagtaatgaggaactgtaaaagccaggataatgtattcaaaagacataaaaattggtcagtttatatttgctaaggcatatttgagctttaattatttataacacttcaccgcatctggagcattattttattaattagtcttgagagccattcagttgcagttgttatgctgcccagctggtttggggagcacagatctactcccatgggtgtgaaaattgctttgaggagtgagactatggtccccaaatatgtctgtggagtatcttggaattttacctacagaagaaccatatatctctccatgacagcaattgatattgactgtatattttctctacaagaaaagagtacaagatatgtaatattttgctacaaaatattatcactaatctgaaatggtatacaaagaaaaacacaaattacctgttttgtaaacatcctgatttatagaaaatgaaagtgaaaatgaacaacatttgattttagtttcaactattgacattttaatgggatttgtatccccataaaaagcatcagcaaaggatattaataatttagaatagagagtaagcagatgactttttaaaaaagtggcactctaaatacttgcggaataagtttacaattacagtgacccatcttgataccaaggattctatacaaacaacaattaaatcaagaaacccataaagagcaatacaatgtacaattctggaaacatggcaaagtaaaacaaaagtccacaaatataagatctgtcaactattagatcttgatggaattttgtactgattctgttctttttctctttttctaactgagttcaggagatctgatacgcagatccagtttcaaggattttccattgttcttttgcccataggcttcaagagcatcactaactagacagtccatatatgaaagggctaccacatacatgtgacaaaactttgagtcaaacaggctactaaactgttctctcatcagcactcaggagcgatgatgttgtttgaggaaggagagtgttttgtgtcaagaatttttcttaaagataccaagagaagcttgaaaaagcattgcgccaaactacaagtaaaagctgtatgtcgtatgtttattgaagcaccattcacaatagcaaaggcgtggaaccaacccaaatgcccatcaatgatatactggattaagaaaatgtggcacatgtacaccatggaatactgtgaagccataaaaaaggatgagatcatgtcctttgcagggacatggatgaagctggaaaccatcattctcagcaaactaacagaggaaccgaaaaccaaacactgcatggtctcactcataagtgggagataaacaatgaaaacatatggacacagggaggggaacatcacacactggggcctgtcagggggtggggggctaggggagggatagcattaggagaaatacctaatgtagatgacgggttgatgggtgtggcaaaccaccatggcacatgtatacctatgtaacaaacctgcactttctgcacatgtatcccagaatgtaaagtataataataaaaaaaaacctgtgcatcaaagtagctctacacactttacaaaaagatgcttaattagaaataaacagaaaactcctgtaaataagaagggaataccactctattctttctttccctgctcttggtctcaatagccttcctttatctaaccagtgtctactgtatactaggcactttggaatgtgctgagtagaaaaatgacagctttccccctcccaaaaatcttcttgaaggacatggtttagcaagagtagtcgatatttatcaaatagtaacacatgtacgtgatgacaaacaacgctatgttatagaaaagtagacaattttagaagtgtgtaaagaaagatctggtcaaatgtagacaacagggaaaagtttgcacaatgtccgagccaagatgtaaaggattattagatgataaccaggatattatgagtgggtgggtataggtaaaagggtttgagacagaggaccaacatatttaaagccccacataagagggacacgcagaattggaaaaagtaaatggaggcagtatggctggcatccaaacagcaagggaagagcatctaggaaagaggaggctgaggccagacaagccagatagtgccttgtcacccttgttgaggattttggtctttttccaagagcactgagaagactactatagtgttaagataaggactgatataattggatttatgttttttacacagattattctgactgaaatgtagagattgcattgtagggtggcaagagtagatgcagaaaggttaggagaaatggtcttctataattatgatgataacaatagtagacagtcaaaaacaattttgaaggtaaattggccaggtgcggtggctcacgcctgtaatcccagcactttgggaggccaagacaggcagatcacgaggtcaagagatcgagaccatctggccaacacggtgaaaccctgtctctactaaaaatacaaacattaggtgggcatggtggcgcgtgcctgtagtcccagctactcgggaggctgaggcgggagaattgcttgaaccaggaggcggaggttgcagtgagccaagattgtgccattgcaactccagcctggtgacagagcaagacccagtctcaaaaaaaaaaaaaaaaaaaaattgacccagtgatgtcttggtagtggaaggctgaaggctggtcatccggaaaaggtactgtaccagacaactacattgttgtctggtatgagaaaatatttagttagagtctcggaatatttagctagagttttggagttttgtagattgcagcaacaaaaagataaagaagcaaagggtttcagacttttgaaaacaagttattaaaatttagatgattgaatctaagttgtatttggaaggaggtaaatatggaagggcagaggaactaatgtataaaacacagagtaatcaatgggctggaagtcctgtgaaattcacgaaaggttaacaggtagctatctgagcaagcacactaaccaagtggggacggattaacttcattctggtgagtatcactcataactctagcatcaccatctccccaagtcatgttctttgtcatgagattcctgagtaaggactgcgttaagtacagacattttaccactcttaacaagcaaccaaaactaataaccaggaatagtgaagcagtatttataacaaaatactggctggaagaaaccacagcaattatttggaccaatttcctcatattacagttgaagaacaaaatagcaatcagaatccatcttatgaagaaatatgactagaatctcagtctcctgactcctagtgcacatgtccagtgattcattttctttggtttctggaactagcataaaattcatcttttgtagaaattctgtctcatttcactatatcgcataatgcattttttaaaaaaggcccatccttctcaatgagtgcttttctatatgtacaccagagtgttttggctgtttattcaaagtcagaacatttaaaacacatagcaccattacatttcaccctaccacaaaagctaatttaatattcagaaatatatgaaggcaaatggctaaaggagaaactggcagtttccctggcatttttttttttttttgcaaagatccctgggtcttctttcatgttctcttccctttttataatttcctatatcctcttctccagaataatataaacccttgacctttcctcaagatgccacctttggctgtatctccacagagatctttcctttacatgctcaacatacaaaagtggtaccattttatcaagtttttattatttggtagtaatttgtttggtttgctattcatttctgttcttgtatcttttattctcatttccaaaacacttatcagtatccactctacaccagacactttactagactctagggtcttggaggtgaacaagacaaaatctctgcctttttcactcagagcttagtagagaagatagaaatgtaaataaaaataaaacaaacaaacaaagaaataattggtcatcgttggaggatgctagtgaacaagttgttattataaaaattggtaaaattgaaacgtattttgcttgttcggtatgaaaggtatactgagtaccaaaataggagacaagtgcaaaacatttttttcatagacctaccccagtgaataaatgaagaaggaatggtagagataggcaattatcacactgcaacccctagccactgatcgtgaacagctattaaacatcacacaaaaagagaaaacaaggcattatataccacctcctgatgatggaagaatacacgaacacctgtgaagcagtcttgccaaaaaaagccaaacccaaatacaatcaaactatagaactgcactgttcaatcggtagctactggcaacatctggctactgagtacttggaatgtaatgagcctgaattgagatgtgctgtaaatgtacattttttctattgattgcatgttgaaatgacaataagaattgtactacagttgcatgacatataatgatgaaaagaaacagggtgaaagatacagggaaactattctattttagaaacttactgtgaatctgtaattacttccaaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttccaaatgggacctgaaaaagaacagcagcgtaccatgtcagaatatctagaagtgtaattgatgattctaacaattccattgaaaaagtacaataaacctattgtgaactacaaagcagtcttgaataaaaatctggctacttacttttgagagccacaaaacagaggatagtttgatggcaattttgagaaaaggcagtgtttagccatatgtttatttccacatgcagaatgctgagacttttggcatgaaatacacactggaatctattgcttttccatactgttgtagtcaacaattcttaatatttctggtagaaaaaattggatgcagtgactaatgaaaaacacttcgttttcatgtgactcatgctagtactggaattctttttgccttgagaaatggaaaggtctctccccacattttgacttttccatttctacaccctaggcagccttttccattgagttcttccatctggcgtctgttcctttctgctcctcttcccaaatgcgtctcctttccccctacccttctttatttgtgtgcacctgggatttgtcttcaccaagtttcaacattttctgctttgtttcctttgtgtaaaaagtactaagacaacaactcacatggaagagtaaaatcagacatttatctgaaagcttcccccgaacatgaataatttaggcaggagactgagtgctttaccgtcaactgtatttagaacacgttaatccttagaagccatttaagaatacacaaatgaatgatctgtgctataaaatccacatttcacttgaagatgagaagctaaattaataaaataaatcatcatccagaaaacaaagaggaaacgcagtgttagcaaagctttatcttcaggtaaattagaaattatgctcaatcactcagctattatcagcaattactaattaattcataataacgctacctataacataaatataataaagactttaacgctgcaaagattgaaatgtaaagcaaagcaaccaggtggagcaacatttcccttagccatttggtaacttagcttgacattacaaatacaattctccttttggccttagtcaaacagaatcaccaaagaatacttatctactgaaattaaattgttccaaactttctgaaggataatttgacaatacataaaagtctttaaaatgtgcaaagacaatgacccacaggcttaaattcaaggaaattatactaacaaagaaattggaaaaagatacaaagatataggtggaaaaatgttatatatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagttactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaagaactgaatcgtgaaataccataaatgtcatgaattgaatataatagtgcatgcagattgcatacaattagaggtcagttcttttatgtttctgtaccatcctttcagttaccacttttccatgataagcctaagcgacaattccccatgcaagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggtagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcactgcacctccacctcccgggttcaagcaattctcctgcatcagcctcccaagtggctgggattacaggcgcccaccaccacacccagctaatttttggtatttttagtagagatggggtttcgccatgctggccaggctggtcttgaactcttgacctcaggtgatccacctgcctcagcctcccaaagtgttgggagtagaggcgtaagctaccacacccagccgggaattcagttctaaaggatctaagagaaacttaatagcatgaaatagggaagttgttagaagccagggacagaggacagtcaagagagctaatacagcagcagaagacggacctggaacctcaaaagacgaaaagctctcacatatctgggtaaggggacttcctttaatttttttctaagctgtggagttagataaaatttcagaatgtttgatcatcctaactacatatcaaattgcttcatttttttcctctcctaaagctcaagagtgaaaggaaaaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtataaatgtgaacattttatataacatttacaaatttttctgccaaatataaaaatctcacataatgtaaattctgctgaaattatgttgataacatattatgtgattttcatagttaatagtatatacaatgatctggaaaaataatctagtagtagactaaattgaaatcttcatatatatttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaagtgtaaattagaatagtattgggaagacctagtgaggaaacagccagaaaagaaaagatttgttatggaatatgaatcaaaatttggagaataagaggaaagagaatgttgcaagtgtgagaaccagcaagggtacatactcatatgggagagtgaggaaattgttggagagtaggaatggggttagaaaatagaatttattgattctcttggctcagagaatctatgttggggagtaacagaatgatgcttggtgagaaaggaactggaggcagaaaaagaaaagagaagggaaggagttagcaaggacttattaggcacagttggcagagagagaaggttctactagattctaatgattaaatataacttcattagagcagtgattttttttggtatgttttattcatggttgcatcctccgtgcccagaagagtgcctagtacatagtaggcattcattaaatatttgttgaatgaacaaataaatgaatgagggagatatggagacctacaagattgaagctttgaacaaaagagtaatatgatataaacagcgtccaaggtagagtattcttgcaaatgtatcaatatggcataacatgatgacttaaataagaatcttaatcacaggaagagaaaagatgtatggcagaagaaaaataaatggaaggaaaacgatacaatatggacttgtatttggaagcacaaggatatctcttatgagccaatggaatacaaagggaaacttcgaaatcatttggatttaaattcaattttgtttctttaaaaatggacacattaatggttttatttttttgaaatataagagcagtttcagaatcgctcaccaaacaatgggccaactgtaattttttataatatgttataacttgggcaaacacaggcctatttttccagtatatcattgaaactattttttaattgtggcaacttttcattttaaaataacccccatggaagaagtgacaagattcataatgcaggtttatcagtgccactaatggttctatatctaactcttccagtgttattctattctatttcataatcatccctaattactgcctatactgtacttctctcaattgaaccctgccatttgctgtagattgatcaataccctaatttcaatcaagtgtcaggaaataagctaaattgctttgatgtggagaattacttctttgctttttatgagtgcttataacatatcctgtattattacataggcctatataaaagccaaaaccattgatctgaatatttaaattctagaattggcagcaccttagataagctaactgttttctacctgattaatgacagcaagaatcaaactgcggtagctgacatgggaaactgctgagaatgaagagtccatattttggctgacatgctatttgccactttcaattctccttttattttatcaagttcacatgaggcagagaaaaggcactaagtgatactcggaacaattatagcatctttctttttcttttgtgcagaaaagaataacttaacttgacctgccaatattttttccatctcacattttcattcttttttaatgacgaaggttatcaaagtggcctacgtcatcacacatactgacctctcttaagagtttaagctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcctgttattatgtagatttaaaatgggcatcttattagttgtaatagatttattccttgccattatgagttggaaagtaatgtatttataactttataaagttcacaagttatatcttctagtctatggacaaaatgtattattttatggaagtgataggcaataaaattctatgataaagtgtaccccagtgccaataatttcattactatatggatcaagtcatattttctatttacgtagtaatctgtagagttaactctgaccataaaagcgtggagagactaataaacaagattgcacttggcccacagcaccagcacattcctgggagtctgtcatgggagagaaaatcttcttgacaacacaaattaagttcaccttggtattatagcatcatacatatagtacagcatcatacatttattagttttgatttcccatttaatacacatttttaggcttgacaggtggaaagtacataggaccttggtaagagttatgataagaggttatgcattcaacttcacttgtatacacacagatcaagaaaattattatagtagaagaatctgacctttacatggtatgtcttcctgtgtaacattttcagcttgaaccgggcactacagcactgatcctgttgcatagcaatcctgagaaaacccagaaactgaaagagccctgctttaaaatgccaactttgcttacattctgttgacagaatgaattttggagcacaggcctcaccagtcaataataataaacggccactttgtactccgcactaaacagtagccaggcgtgtggatgtgggaggaacctcaaagagaggaggcctggaatatgcaactgacagtttatattaaacagccaacttttcttatcattctgccattacaagccagagacattataaattcattttatatatgtgtttccttccttgttcccagcagaatagtcaaagccaagggaacattcctcagagagctgccgggtaccagcattcctttctgcctacacaatgaatggaggctttgtatattatctgacttgctcttagagatttgtatgcttctgttcaacaagtttaaaaattcattctgaagctccaaacaattggattgatctgtgtaactagaaaagttttttttttctctctctctctcaaattgaattaaattactctgctaaagtaagggagaaaaagtggcagaaataacatgttagaaattctgaagaactggctcaagttttcagccacagcctcttaagatgcagaattctgaatgttgaacaagtaaggtagacagacaatgaatgtctattgtcactatttttggcagctaaagcatcactgatggactctaaagagagttgtgtcccattctctttgactgggagacaggcaggggaatatggatagaatcacatcagaagttgaaagaagggaaatactgaaagtatttctgagtagtatctctgagtagtacaaaccaggtttgtactggaaggatatagcctgattttgaaagtagtttatatggtagaaggttagtattgggattcttgcagaacgaagtttggtcaaatatatagccattttatgtttttctttcttttttccttttgcctacgtggaataacatgcctgcctaatttgcacttcttcagcaaaagagaaaagtgagttaatttatctaagtacttcaggagaaaaagccaaccagatctaagttccagataattccttcacttgtcttttactttacttcttctgttgtacttgatttgtacagtactttccttttgtgtatgcacttaggggattaaagacaaacttttagttgttcaagtaaaagtattctcactagtagcatcagttttctatgtttactacattaacatacatataaaggatagtacatttgaaatttatatcctacattgatagcagagacccaggctcaatcacgagctccttaaggttatgtataccatgaagtcaccaacactttctttgtcttctcaagcataaataggatgttgattcatgaatttgctacttttcatctttgccatatatattatactgcatataaacatctttgttgtattatcaacaaataaatgaatataaaattgataaacaagcatttattgaggactgatttattgtctagttttagcactttgggaaatgtaagaggagtacaaatgatagttctgtctttaattttcctaaaacctagtgtgcatttttgtttaattcgtttatattaccaactaaatattgacggcaattcctgccaagtcttcatagatactgggataaagactccttcctttagaaatgcagaaatggctaaagttatcttagcattggcaagaagataagtcttctgtcagtactgcttttctaggtcatgatggtgatacagagctgtaaatgacacgtgtacagtaaagggctttacaggttacaaagcacgtacaaatgtaccaccttagttattcctccccctggctctgtgaagtacatcacattttctgttttgcagatgagagcactgagactcggatgtttaactgacttgcctaaaagccatatagctgataagtgttagaactgggaaatggatccaattctcttgattctagaagatcttgggctgcctccaccaacccacttgccagaagcattggatataatacacagtagtcactgaacctgaacgaagatactacttgcaagaggaaataagtgactgttgagggaaaagcaccctgaaagacagcattcttgagtttgataaaatgtttacccacgtggattgatttgttctgaatgaaaaattgaattctgactgctctttttttttttttttttttgagacagagtctcgctctgtcacccaggctggagcacagtggcgcgatcttggctcactgcaagctccgcctcccaggttcacgccattctcctgcctcagcctcccaagtagctgggactataggcgcccgccaccacgcctggctaattttttttgtatttttagtagaaacagggtttcaccatgttagccaggatggtctcgatctcctgacctcgtgatccgcccaccttggcctcccaaagtgcttggattacaggcgtgagccaccacacctggccctgattgctcttttcacttctcatttagcattgggcatcctggaccacctgtgagcaaaaaatgttcacactgaaaaggtctcctttctgcaaatttccctgttgccagaacagaaattctgccatcagtaattcatctctttgtctacaagagccatgtggactactatgaaccataccaagaaatgacttgacacatcagcataaacatagttcatccatgttcctttgggatggcaggctggtaggaaatctttcaagctacaggactcagataggttgccctaaaaggaaggtaagtattgggaaagaacccaaggctctctttcaaaagctggcatgctgtagtggagatttttcagtatcaataaggcagcatgagtcatagattgggaatgcagggcaggctgcaaggaatatacattatacataatataatataatataatataacataacataatataatactaccataatgatatttgtctaaactcatcattttttatttatttatttatttatttattattattattatactttaaattttagggtacatgtgcacaacgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttctgttcttgtgatagtttactgagaataatgatttccaatttcatccatgtccctacaaaggatgtgaactcatcctttttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgacttttaaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcacccactttttgatggggttgtttgtttttttcttgtacatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgttaaagatcagatagttgtagatatgcggcattatttctgagggctctgttctgttccactgatctatatctctgttttggtaccagtaccatgttgttttggttactgtagccttgtagtatagtttgaagtcagctagtgtgatgcctccagctttgttcttttggctcaggattgacttggcgatgtgggctcttttttggttccatatgaactttaaagtagttttttccaattctgtgaagaaaggcattggtagcttgatggggatggcattgaatctgtaaatcaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttgcattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaataaactcatcatttaaagactacacctcagactcaggtagcacaaaagagcaaaagattgatatggagaatcaagtggagttctcagtgggtagccaatctggacaaaggataattttcatagaaatttttggatagttttatttcacttctgacttaactagaaaagatcattcaagccttcattactgcattcactgtatgctctctaatttttttcttcttttttgtgattgtagtctttaggaaaagcaataacgaatgaacaaaggggaaaaggtagttgttacataacaaaaaccatagcagcagcagcagcagcaagaacaacaacatacatgaaccttactgtacatcaggtgctgtccaaagcactgtatatacatgagctcattttctcctctcaacaaccctctagggtaggggctactattatcttcattttccatataagataatgaaactactgtaaggttaactaaaaatgcccaggttcacacagctaataaatgcagcaagatttagaacctcgtcagtcagacttcagggattgtgctcttagccactaggctatattacctttcaagtttagttgttggtggtagtttttcctattaataatgctactacctaaattttagcaaatctagcactgccattagaaaataaaggataactatgtcagcacacaaagagcaatttcatggtcttattaatataaagactattaaacagatttgtagcagtggatagagatgcatccaatacaacaagagaaaacacaaagtaattgagaaaatgggtgcaaacgaaacaaataatgtgtgtccccataaaagaaacatttggcctaaagttctgtacaattatagagcaaatttcagctgagagtaccaaaaaagttcagttatgagacaagcaatatgttcacagtatagcagttttaggagtaggggagatcctgttttctgaagggctttttcaaattccacacttccttcttatctgagtctcatctactcttgttgtgaatctcctttctcagcttccagagaaaactcatggcaaagtgcagttaaatagacataggtttgacccttctcttctctttcccttattagccacataatgatgaaaactctttcattactttggtttcactaaacatgaaataataatacatacctgctgaattttttgaatattacatggaatttttgtaaaatactttgaatagcgtctagaacacaagagatctttaataaataatagcaaatgcagggcttactattacaagataatccatgtggaaatcagatgttagaaatagatttcatgaagttacaggacttggcttgagccttgagggatgtatacgattgggaaattggaacaaaagaaaatattccaggtaaaaagaatagcatgggaatggagtaaaggtgaaatgaatttggtttatgagcagggacaatgaattgcacaacctgattggaatggacaatgagagttgagagaaataggtagaatgcagaccaactgcttaaaccaagtagaataaagtcttcctttaggaagccaccgagaataaaagtttagaaagaaaagtacaaagacaagattatcgaatattaaatttgtactatttcattcaaaaagtagaatgatccatggtgttcataagtaataatacaactggggaagaataggaaaagttatggatgttttactagaagaaaaataaagaagggagatgtcaagaattagtgctgtacccttctttttattattaaccattttattaaccattaagcagatggttgtgatactattctagaacatcatgaataatcgtatccacatatttcctttcctatgtaaatggaattattggtctctaaaataggactcagcaaatgaaaacttccccattttaatatagctgagaagtaaggaaacaaacacaatggtgtagaaagaataacaataagtgaccaaatctccttaagaattttattatagacagattatctctaagcttttctgaaagcagttagtatatgaataattataaggccattagttcctccttactgataatttttatctaatttaaattagcttgatgggaaaaaaagtggtctgatttctaagaacttagaaggtcaggaacatacaattcaaaatagtaaagaaattatcctaagtggctaaattgagagtaggaagaagtgacaccttacagagaatcagaaaggtgtaaaaggagccatgggcatgcataattgaccagggtcacacagtgtggaaactaacagctctccatgcatcagtagcccttgaaggcatcacctcgttttatagcgaagcaaaatagttaatgctcaggatgatgatgctgaattagccagggaaagcagatttacattcagtaaaatctgtttaagaagaaagcagtgtatgtaaatgcttcaaatgaccaaatgactgttatttgatacagttgttttgaaaaggtgttaatgatttaaataaaaataaaacaaaaacaattatatgaaagtagaactcccttagactggttatccaacatgactcattaaacatgagctctaaatagtagagcttttggagcacacttgcatacactcatacgtatacacacacagaaacagatattctattatgaagacataagaacagaaattgaaagcaaatctttagaaacgtgtacagcaatctaaaaataaaaagcatcggcttaaattttgtatgtctggtatttgtaatttttaaaataattcatttttattgcatgttacaaaagtatcagtctattatggattgggaattaaaacaagcgcaaaaaaaaaaaaaaaaaaacccgaagtggatctttcctaacaagtttttcgagaagaatccataggaagaaattggacccacagtcttggccttatcaggattctaatctaaccaccggaggttcctaaccagatcagaaaatgcagttggatacagactcacaagagggtgtgactgttttttcccttcttattctatatgtggccacgcaacacctttaaaagcagcagagttgtcgtcccaagagaaacaagagttaatttgaggactgctgtttggcttggagcctggttgctctaggtagataaggagtatgttttcaggtccactgcattgcgttgcatcttaaacgagcagctatggatttaggagtccacaggctttgctttaaaaacggctgttattaaagtcctcagagactattatcctgcagggtttgttgtctttgctttcatatctcattcgaaaattctcacacttaagcactgcaacagcagagagaagggatatgctctctcagcagggagaagggatatgctttcttgcctcagtatattcccaagtgcaaagcttcatttcaaaatctaatctttaaaaatgcctggcctagggtggattacccccggaggaaactgtcaaaccgccttaagcaatcccgaactctggtaatacgtgatgctttctctccttgtgtgaccctctgactccattcttaagattaccttttaaaactgatgagttcatttaagatctcctaggttggaagtaagatgagaggtatctttctcatctacgtcttgtttttcctagtttcttctcatccagtcacaatgcaaaaattcccgaatatttattcatcacaaaaatgtgcattaagtacctattgtatgtctataagtagggccgataatacctaccttttaaggttttggcaaagattagatgagatgatgtgagtagatcaaccaagtacctaacccaatgcctaacctattgtgaggtttcattaatgttgcatccttctagtccccctctcactttctgccatgactccaatcctgctagcagagaagatatgaggccgttcaaaagaaaacgaatacctactgcatgaagatgggagccagagctacaggcaggagctaagaggtagttctcaggaagttcaggttcaaagggtacagtgtagccaatgagagcttagaatgccgcctggagatttttatctgattctgtaaggataatattccactgtagcttcttgtgtaaaggtgtaacattgtgaaaatagcatctggtaatgattattgggaggatggtgttcagggtaaatgtagcagggtcagagtgaaggcaggaagtctagtggacaggcagtcccagccatacaggaaccaaaacagcagtggcttcagaatcagagagaaggtaaagaagagggatgctaccatcattgagtgctcataagttataaaaatagctgcatgtgtgatttaattccatccttctcttgtcctacctttggaaggtagaattcaggaaagtgataactattcacaagtacattttaaagatagaaatgttatttaaagttctatttctcaaggagtaagaaaaaaatacatatgctgtgtttcaaacacacacacacacacacacacacacacacacacacacacacacaccttggggccaaataaattagaatgacaaaaccattgacaccaaatgacaagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatactgcatctaaaatccatagaaaatactgtgctgcaatattatttctgatattgctatacagcctcagtgctcataattgggtgagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggtctttccaactctgagacatatttgtttttgcagagccatgatgaggggtgggggtagggtagggggatgaaacagggcaggaactaatacttacagcccttataaatcctttacaccaactctatgaaataggccttctttatcccctatcgaggaaaccacgagtttgagaggtaaagtaacttatacaaatcatagagttgttgttatgtggcagaagcagggttagagcatagatcttcctgaaactaggttatttttattctcttccctccaagctccagtgtcttccccatccattaaatacaaagcaagtgacttctgacttgggctacatgtatcacagcaacataattataataactcattaaggcatctgtgagatatttagtttcagagcactgataggaatggtcaacaactgaataattttccaattaggtattgcttttaaaaatttatccttagtcaactcagaactaatatcattgatgtttctgaatggttctaaatgaacacaatacactcctattcttcaaataggtaactctcttcccatggaccaatacatatttggttatattaatctgtgcaatttgtctatattacatagagagttaaaagctcgaaaagctcttatttctggaatctctttgtcactaagctattttttgtcctccagagaatcactgtggttcaaggttgtatattagaaaaaagcaattagttgatgtcaagtctcatcttttcccaataacacatatctaagaagaaagcaagaacatatggcaaagtgccataattatttttgatcatacactagaaatcacaacagccatgtaggtaattccctctggcttgttttaattattagggttgtaaatgcaaacaacaacttcattctatcccccactttaccccctaaaaacctcaaaatactcccacgcaaccacaaaacaaccctacactgatgtaattgtttacaataggttaatgataggaaaatctaagacatttctatttttttcattttaaatagcaggacaatttccaaaataatcacagacactcatcagacacaactgtattcatttgtgggtactctttagcccacagcatagagatattaaccttaaaactatttctaggtattcataagttttgaatgttaaagaaggttctagtaccatgatgtaaactaaagtcctgctgatataattggatctgattctctggtgatcttcagtgagttaatttctgtctactaccaagtagagcaaattctttcttctggagagtgtgacttttgtgtgtgtgcctagatagttctttcatcctattttgcttttcttctcttatacaatagggtgaacagtgatggggagaaaacaaagttactcttttgttaatgtatgaggaaaaggaggaagacaggggatatgcatgtggacactgatgtaaaggtaggtaatatttggcatatttgccgggaaaaaaatgtcataaaggaaaagtaggcaaaatgctaaggtacatttcctcattcttagaacccattcatgagctttccattgtgatatggtttggctttgtgtcctcacccaaatctcatctagaactgtaatccgggggaacctggtgggaggtgattggatcatgggggtggcttcccccatgctgttttcccatgtgatagtgagtgagttctcatgagatttgatggttttataaggggctcttcccattcactctttctctctctctcctgctgccttgtgaaggtgcttccttcccctttgctttccaccatgattataagtttcctgaggcctccccagccacacagaactgtgagtcaactaaacctctttttctttaaataaattaccccagtctcagggaagttctttatagcagtgtgaaacgaactaatatacatcgtgtatctattaattcttcccaaagcattcagttcagttcagaagatgctagagacccttagaccatctcactgaagcaggtccagggtattttttgtgtccttgtgccatgatgcaatgttcttttcttcttctttttttttgagacggagtcttgctctgttgcccaggctggagtgcagtggcgcgatctcggctcactgcaagctccacctcccgggttcacgccattctcctgcctcagcctcccaagtagctgggactacaggcgcccgccaccacgcccggctaattttttgtattttaagtagatacggggtgtcaccatgttagccaggatggtctcgatctcctgacctcgtgatctgcccacctcagcctcccaaagtgctgggattacaggcgttgagccaccgcgcccggccgcaatgctcttttcaactgagaacaagtacatttggaaaatcatccccaaaagagcaaggtttgggaaggcttaggcctttccatgcccatatgacatgttatataagtcttatgaagaactagaacagataagaggatgactttacagattattttacaagaatttttacatgagaatgacttttttttttttttgagacagagttttgctcttgtcgcccaggctggagtgcaatggtgtgatctcggctcactgcaacctctgtccccctcctgggttcaagcgattctcctgcctcagcctcctgagtagctgggattacaggcacctgccaccatgcccggccagtttttttatttttagtagagacagggtttcaccatgttggccaggctggtgtcgaactcctaaccttatgtgacccacctgcctcagcttcccaaagtgctgggattataggcgtgagccactgcacctggactacattttaataacgattaaagaacagtggaaatctgcttcataacaccctgagtaagaaatgagaaattgtagctgcatatcagcattgtcgctgaccctgagtataaacgaagaagcctcatggtgacccaaacagagaattgttaactaagtcatgtccatagtgctttaccatggacaaatgtttttgatccacccttctaaggcaggggtagaaaagctgttgaaatgttgtaaatctctgcttgagtttgtgatacggttttaaatttagcagaaaaatattcaccaacaggagaatgagaaaccaacgtggataattattaatgttatcctgaacagaaaataaaaagacttgctgaaaaacctttctgcctggttttgtcagagttctcttccttttacacattcactttttgatgttttccttttgtgggctggcagaaagatgggggtcactctaaacttttactaaaaatactcttaaaactacaagatgtaagttctctattttaaagagcccatagccttctgaaaaagtcttaagcaaataaatgaaccaaaataacatgtgatcatgttaaactggaacacagccctgtgggaacaaagaacaattagccttgccccccaagatttgcagatgccatcatacaagtgatgatatttgatcagggtcttgagggatgagtagcagctggccaggggagaagtgggagagtgaaatttgaagcagtgggaaaaacatgaatgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattagaggcaagagaatatggagatctaaactgaggtaatagacacaggatgagaaaaagggagatatttttgagagatcatgaatacaacttagagactgactgaatgcaaggataacatatagggaggcaagttgggtttctggcttagagaagaagatgggggtgataatgctacctattattaaagtgttgaatttccaaggagatgtgagcagtttaacataggcttagcctgtcacttagtgatagggtgtggaagggagagtggtgttgacctttgtcggggggtacgtgtcatccactcatgggcatggtagcctgaaataggggcggtaaagaagggcccagcagggagtcagacagtctatgttgtctttcttgctctctcaggcgtctgtgttctttgtgtcattcacacgtgcctgtgagcgtgaacttgcatcatgcatcagtagttcccttagtacagtggttctcaaacttgagtgggcttgagaatcacccagagggctcattaaaacacaggctgctgggctccactctgagagatcatgattctgtatgtctggggtagaactcaagaatttgcatttcttagaagttcccaagtgatgccgatactgctagtccagagaccccattttaagaatgaaacactgttctagcataacagcccttaatcttctggaggtcatgaatgcctttataagaatgatggatcttctcctcaaaaacctgcagaaatatttataaacacaaaatacgacctattacttcacgggcttctgctactgccacctccacctccacccccgggacatacaatggattaatgaagacaacgtatccttccagtaccattttaaaggagaacccccaagaagaagaatacattggaaaatggcaccaaaatgtgattttacttatttagttgtcttagaattactcccagtgagcctacgtacaaaatgacccgatttggggaaggagacctgtcaaaggacagttcttgggtgcaatgaggaaattcatttcactctaaccacattcagataacctgaccttttcccattttaacctgccattcacttgggaagtaacaaataacagagaggtgggtgggtaaccatggagaaaagggtgcattcagccaggggcctgcctgtggaaggacggagcagtttgcacctcggggaaagcggaggtagggctctaggctctctgtctggtagcccagggaaacagttcaagatcaaaggaaaagataattaagaatgtgcttaaaagaaaacttcaaatcagctgtgctacacaaagatatgagacaatgcctgttgtagagaaaagagcattttgactttaccctaagaatctttcttatgtgctttccatagcccagcggtatagttatttttaaatgaccctggaaaggaagcagaggtgttctttattgcatgaatagaaggcaatctttcatttaaagaaccttaaccccgctctgcatgcatgcatgaagtcaggaacacaagggcaatactgtattattcattttggcaactataaattcaaatgatggctctgaggttggggagaaaaaggcccgctgagctggagagcagaacgcttccttcagcttatcaaagaagtgatagtgctacaggcaggagtgccccataataatctagggaaaatacgcctctgagtcaatgaagattttctgttattgcatgggctgttttgcctacagccaagaaaattctgtctgatggtaatgttttagctgctgattcatctcctctgtcttcaattcttctcagcaaacttttattgggtctcatcctgggcacatttacagagcaatttccataatgataacatctcttcaaatgagatttaaagtgtaattaaaaggcacatgtgttgtggcaaaggcgttgttgtgcagtgaccatacatcatcgtgccatggagctctcactcagccagcctatggaatgaccccggtttcactctgataagattccatggctttgtttgaggctaatggcttcattagaaaaaataaataaataaaagaagataaaacaagctctttattggagagataagtccatgaacatgcgttagacttctgcacccttctcccttcgttctgtctcttagaactcagaggcaacaagaaactccttgagcacggaagtgaacactaacaaacggacaggtgaaagctgaaaggatgtgcttgccctgagaagctgagctccttatgtcctatggcctactctcatggttttaagtgtgattgctagaaaagtggaaactacaggttacaattccctgaatggatgaatgcttgctcctgaaaaactgcctggtgcctgagaaagcaaggaaatactccttgagtagtcaatgtttgaaacctccaaagtagctaagactatttcttcttcactgtaaaatcaatataagatttttaagctttggaactactcaaacccgaaaatagcttgcctacccagatcctgactcatagtattcattaaatgatatgaactgattttttacttggctgctggttttaagtattgatagataatcatatcatatgacagggaaatcatattaacacatggggcgaataaaatctttcaaaagatcagttttgagatccaagatgatcattaaataatagattctgaagcatttaaaagaggacttggaacttttaaatgccatatgttcgatcacctttttaaaacataacatgacaatattcatggagactcaatatgccatgtaatgtctacgttacttacagcagagagttccactaattttctgtgctcctttctttgcctaaatgaactatttcatttagcacaatattttgtttgtagaataaaatttatccttgtgatgttgggagttatgaaataactcatgtgttttaaaatatcattaaatgtacggaattaaactataattagtagaaatcatttgagggtctttaatttactgatgctgacaaattctcatcaaatagttactgtgctttcaagtaaaataacatctttgtaggcagatgtaagacactagaaaaataatgtacactttcaaagagaaagtgaacctcccatacctctgaaataaaagcaatttagaaatctgatatattttaaaagaggcacataagttaatctgtaaatttcactttactcgttgacggtgaaatgctacgttcaatctgttgttacagcaaaaagttaatggaaagtttgacttcactgtaacaatatcctcttttaaccaaataaccttccttaaaccttggataaaattcccctgtttcacactatcaccatcacagataaacggattgaaaagacaacaccattctcagtagaactgtttgcttacactcagttagccaagcttctactacctgatttcattgccatggaaaatcctccaggataacttgggtagcagctacctctattacttctcccaacatcccactgcttccagttgctactgtttgctgttacaatcagtggtagcctagaaacttgaaccacccaagtgttttaaatgcggaagagaaaatctgagggaaaattgggaaggaaaaagtgtttccatgtttccgaagagcggcattgtgcttgtatgactgtttttcatcagctttgactttttggagaggcagttttacttttcatagctagtctaatatttcttctcactaaatagtgaattaacacagtgcaaatttagcagtcatccttttgacatctttactcataaaataagtaaaagcaatccccaacttacaaagagttctctaaccaaaaatcacttgcaaataaatggtccagaaccccaaactcaaatttccatggacacaatagtcatatacatgtctcagaccagcatatacatatatagctatttaacctataccatggatgatttatatcattttgatagcatgactttgggttatatgatttgggaaatatgcatcttttgggatatgaaagattcaagaagtacggaaaagaaatacttcctattttaagacctggatttgtccaacacccaacaaaggagatatataaatgggcatctgctctctccttccaccttctggtgcccatattttctactcccaaacttccttatgttttaatcctcattctcttctatctgttgaaaatcttattcccaaagtatagactgacaactttcacattctgggagatttttatattttaaaaagaggggctgggcatggtggctcacatctgtaattccagcacgttgtcaggccaaggtgggtggatcacttcagcccaggaatctgagaccagcttaggcaatgtggcgaaactctgtttctacagaaaatacaaaaagtagcggggtgtggtggcacgtgcctgtagtcccagccacttgggaggctgaggtgggagggaggatcacctgagcccagggatgtcgaagttgcagtgagccatgattgtgccactgcactccagcctgggtgacagggtatgaccctgtctccaaaaaaaaggggaagctgagttaaaccaaaccaatctgaatcacagattgataggatttccaagaatataagaatgcaaagtaaaaatattcagatggtagcataagcgtctgggggcagaaaggctttagctattcttggtaggcaatctactttggttaatactgtgaactggctcacctaaatctacttaccatccttccagttggacaggttggaaattaaaaactgtatttgccagacttccatgcagctagtgttctgattatgaattaggatataataagttagggttgtcagataaaatacaaggcacccagttaaatttaaattttctacacaatctttttttatttagtgttaagtatgttgcatgcattatttttatttgctaaatctggcaacgttttgccaaatgtgtatacttgtgagagatctggaaagtggaagtgaggcataggtcacctttctgccccttttggctatttctgttggcgagcttagtcaaagaaacatgagatttcctacatcagagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactccgttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaacactttactattatttttctcatctcttttgtccctcatatctagatgtcaaatttccactgacaagtaatttgatgcctagggaaaatattcgattcaacagtttcataacatgatgtcctattaattaaaacatgatacactgacattaaatttccaaatgaaaagaagcccagaagtgaaatatcacaaacttgatacatacgtatagtcacatggaggggtggagggatactaaggaaagacagtgtgttttcaaacctggcttgcacgtgtgaggtgaacactggagaacagaacttacctctctgctgtcagcacttggaacagcactgagcgcactcgaggcgctcaataaatcgagcttaattttttaaatcttttcgctcccttcgcccattctgcatatatctcatgtacaatttcatttcccaaaagtaccaggttctaacatcaggaagaaaatatatggtgagtattgaccatttctggtggtcaaggtctctactcttaatctcatgtaattagggtgatcctatagttcattgtccaaacctgaacacttttgagagtgtccaggatgctaataataatcacacagggtcaggcacactggctcatgcctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaactctgtctctactaaaaatacaaaaattagcagggcatggtggtgggcacctgtaatcccagctactcaggaggctgaggcaggagaatcgcttgaacccgggaggtggaggttgcagtgagccgagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagacaaattaggatagatgaacctatagcagtcaataaaatgggcaaaagggtctcagtagcagcagaggcagcctttcttcccgctcattctctccaagtaacaaaaggtctgtgacacgacgttctctttctgcctggggttcactgcacgcagtgaattgatcactgcacctgtttcttacattcagggaacggaaagcagagaaaggccagtggttcacaccactgtttgtgcacccaggtgccctctcaccgtggggagtaaacaccttcggttctgtttgctacggaaaagaaaaatgaaaagagggccaataacaaaatgcccttcaaagaaaacactttgtgagcctgtgtgtagcaaagataagaactaggacactgtcatgagaaagatcctagaatagcttcttgaaagaaagatttctttaaaaaaaaaaaaaaagaatgcgagtgaatgttgctacgacatctattgtgtattatctgccatatccctcttagcaaatgacgattaaagtttctgcatctgtcggtaatgcaaacgggaaagaattcactttcctgaaatttactttaaattttcctttacggagaaatgattcattccccctgtatttcatacctgatatgtaatacagattttatgtttaaaaaaatggctttgtggggctcccatactaaccaaaaatttcttcctagacatttctaactgtatctagagaaaacagggacatcaaaacaaaacaagaacacaacaacacagcaaaatcctggattttcaatttataaagtcatggatgaagaactggtttaaacctaaaatccataatcagagaacttcaaagagatatggtatattatacacatcagccttttccttttgaagaaaagcagagagaagacactggaaggggaaacctcctgctactctgggagctcctaagggctgggaccatatctgccttgtctgcggctgtatctcccacttccagcttgatagctggtatgcaactgcttttgctttcaataaagttatcgagtaaatgattggatacattaatacattgattagttatgaaagacatcaagtaccagagaacatcaaagaaggctaataatgagagtcaagcagtgggtaaccttggtatatacctagataatagagcactggtttctcttttttttttttttttttttttaattttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaacggacatgaactcatcattttttatggctgcatagtattccatggtggatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcggaaattttctcccatgttgtaggttgcctgttcactctgatggtagtttcttttgctgtgcagaagctcttgagtttaattagatcccatttgtcaattttggcttttgttgccattgcttttgaaaaactttgaaaaaaatttagaagaatgtataactagaataacgaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagtaaggcaggccaacgttcagattcaggaaatacagagaacgccacaaagatactcctcgagaagagcaactccaagacacataattgtcagattcaccaagttgaaatgaaggaaaaaatgttaagggcagccagagagaaaggtcgagttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaggagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatattttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtactaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtttctcttgatagcagcccagtttactgtatgattgttttagccaccttttccccctccaatcttccaagttacagcagttctcctcactaccaaaagtgtgatggtaggactatagtttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccctgatgttgtaatagaagctgtactttccttcctatctgaagctaatttctaaatttcatctttctgccttctcaagtacctgtgctattgattatctctaatttctcctgcatcctcaacctctccctctctaccatcttcttctcattgccatttaaacatgtgtaagtcactacccttttaagagtgtgttcttcctgcccctacatccatcttctgctactatggccctttctctcttcccatcgcagccaaaagtcttaaaataattgttttacacttgctcccccactttctcaattctcaatcatgcctgaacgtactgcaatcttggttctttagttaccaccaagtaattactgagttctccataatcaacactgaaatcacttgcataaaggttgtcaataccttccttgttgctaaattaataggatatattttggtcttatctttcatgatgcttttgtagtatttgacacctctaaatgttactttttcttgaaaacctctcttcccttggattctgtgacatcacacgaacctagtctgtctcctatctactgaactgcaaatttccctgtctccactgaaagcttatttttctttatttacccctgaaactttgccattttcctgggttcactcctaggccctcttctcatctacgaactttactctgaaccatttcaaacccttgcaaggttttaattacgtatatactgataattaaatatccaattaaagattctctagcctagaacatttctccataggttcagctcacatacctaggtatcacaacttagttacactatcatcattactcacctggacaatttcaatagtgtgctgaagctatcttcttgcctccagtttgctaagcttcctctagtcccttgaaataacatgacatgactttctcacttccaggcctttatgcatagtattccatctgctgggactccacctcctccaaatccccaacttgacctgtctaactcctgcttctcttcaggtctcagctgaggtaaggcttccttgggaaagccttctgcatcctgccaagccagggtcaattaccttgatgtacacccgtagcactatcatagtaatacccttaccatctataggttgaatatctcatatccaaaatacttgcgactgaaagtatttcaaatttcaggttttggaatatttgcattaccctatggatatcatgcaggcctttagggcattttcaacaatatcttgacaccaccagagaatataccagcaaacacagtgattaatgcacgtaggttttggccccatgctggacattgtagggtacctgccgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacaccgagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattgccttgagaagtgctctgatacagagctgactgactagccatgtctttcaggggtaaacgagacagaaacggaagccattcacgtattttccttccttgttccagttaatctattcattttccagaagagaaaattaaggtccagaaaagcaatgcaacttgctcttaacatcagtgctggagcagaacccaggtttctgtacttctagcctacgtcccttccttcacacctggtttcaagattccttaaagataaattataaattctagccctaagatttgctgcctttcaaattttaacctattttcaaggttaactacctgcctttggtcaccagcataaataaatctggatatgccatgtgagaacacagcatcatcacagcaaatagtctttagcatcataaaactatcacataaaatgtagtgccaagtgcactacctaaaaggcacatgttataagtagtaggggtcattgtcaatcaagttaagcaatgcaggggggaaagaaattgtcagaggaacaacgaagagatcatctgtaatatcgttttgagacatatttggcttgaatctatacaaatggcagcagaatacttgcaaggacttttgtcccagtgtgaagaggtaacaactggaattgattcaacgtctattaacattggtcatggtgctagatactgagaatccaccagtaaacaggaaagacatagtccctatctttgtggttggttacattttagtagagaagtgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaaggaaaccaaggagttcttataataccagaaaacttagaagcccttaatgcacaatattacactgacctacaaaatgaccttcgcacaaagttaacttattaagaagcaaggaaaataggtagaaaggcattgttggtacaaatagaaacgctgctaaaatgccgagtctggaaaatttgaaaaagatcttaatttccaaaactgtttctgctcagaaagaagtaagaggaatatcatttggtgatataaaacttggcccttttgagagtgtgggagaaaatgggtggagaactattgattctgacataatcactgcaaattttctacactgtcattgattaatttcttcaataaacatcgatttaggatctactgtgttctagggctgtgctgctctgtctaacacaggagccactggctgtaggtagctaccgagcaattgaaatcaggctagtgagacggagagactgaagtttaacaaatttttattccattttattaaatttaaatataaatttaaaaattgactcttggttcagttattgaaaaacttttgtgtatgtttggaacaacttaggaatgtgaatcttcttttttcaactataaagtttatgaaatgtaaatagagaccaaatattttcttttttttttattatactttaagttctagggcacatgtgcacaacgtgcgggtttgttacatatgtatacatgtgccatgttggtgtgctgcacccattaactcgtcatttacattaggtatatctcctaacgctatccctcccccctccccccaccccacgacaggccctggtgtgtgatgttccccaccctgtgtccaagtgttctcattgctcaattcccgcctgtgagtaagaacatgtggtgtttggttttctgtccttgtgatagtttgctcagaatgatggtttccagcttcatccacgtccctacaaaggacttgaactcatcctctttatggctgcatagtattccatgatatatatgtgccacattttcttaatccggtctatcattgatggacatttgggttggttccaagtctttgctactgtaaatagtgccgcaataaacatacgtgtgcaggtgagaccaaatattttcaatgaaaatacggtgtccaaattgagatgggatgcaattgaaagacacatgccagatttcaaagacttagaatggaaaaagcaaattttattaatactttttattgattacatattgaaataataatatgttggatatatcagggtcaataaaatattagtttcacttctacttttaaagaacgtggctactagaatacttaagattacataggtggctctcatttctatgggacaacactgttctggacattgtgctggcattgggaacataaaactaaacattcccttaaggattttacggaatggtggtacatttactgctatagcagagagatatagaggaatgcaaaggacgctatggggacatagatgagtagcaattaaattaggctgatgtcaaccatggctacctaaaataaggcatgcttaaattgatccttaaagtttgagtggaagttagatgaagaaagacgaagggtattccaggaagacggaatggcatgtacgataacattgggagaagtagtacaatacagtgattaagaatctagaacctctaccctttgagtcatatgcactcaagctgtaccacttactatctgtgagatcatatgtaaattacttatctgtatctctttccttctctgtgaaatagggatactactactgtcaaccttataaagttatcgtaagaaatgcatgagttaatatactgctcagaactgtgtctggtccacattgtatttcctgctattattgtgaattagaaaatactcccacaggttggagtaaagggaatactgtctgtgaaagtgtcagggaagatggggctacagaggtgaccaggcatcatgcattcaccagagcagtttgaccttttatccttcaagctgtgagaggattagtcacatcttgaaaacatattccaggcataagagtagcagagcatttagatggatctaaggcaatagataagagataagaggccaatgcagcaagctagttgagcagtgctgcggggccactgcgaatagagggcagggcatgaataaggtggatatggttgctaaatgctcttgaaacctttctctgcttctttttaggtatctagctagacttcattttccagcccctctgctgttacatgtggccacagggcagagttctagccagtagaaggttgagtcaaaggacatgggacgcctccgtgtgcagtcctctagctcattcccctttgggctggctgaatatcttcaggagggcaacctcggcaattggctattgcagatggaagacccttgctggcctgttttttttttaatttattttttattttttatttttattttattttattttttttagatagagtcttgctctgtcgccaggctggagtgcagtggcatgatcttgtctcactgcaacctccgcctcccggcttcaagtgattctcctgcttcagcctcccaagtagctgggattacaggtgcccaccaccactcctagctattttttgtatttttagtagagatggggtttcatcatgttggccaggatggtctcgagctcctgacctcaggtgatccgcccaccttggcctcccaaagtgctgggattacaggtgtgagccactgcacctggcctggcctgtattcttgaataattatgtgggtgtcacccctcccttcccacacacacatccaacaccaactaacatgaattcaccttagactgtttacatgagaaagaaatacatttctattttgtttaagtcattttaatagtccatttggtggatgtttaatatattatagctgttagcctatcttagctattatagatatgaaacatacttaaagagctaaaagcatttttacgaggaaaaaaagacttgatgacagataagatatgagagtgatgaagaaagttgtcactaaattctttgagtagcagggcctcaagtgttatcttgagtgcaaatataaacagtgaaccgataagtatgttcttggtgaactcgccaaagtaaattttcagccagcaatgaacaacagtaagaagtaggaatttggtgaggttaaagaaatcaggtatcttcctcaattcagcagaaaagaggtcaagtttcaaaagacattgggaagtgtgggtgaccctcaagaatttagataagaagaggaaaactgtcagagtcatttggttaaggtattgataagattcaagctatgcggctgggtgcggtggctcagcactttgggaggccgaagtgggcggaccacgaggtcaggagttcaagaccagtccggctaacatggtgaaaccccatctctactaaagatacaaaaaatttgccaggcatggtggcatgtgcctgtaatcccagttactcgggaggctgaggcaggagaatcacttgaacttgggaggtggaggttgtagtgagccgagattgtgccattgcactccagcctgggttacagggtgagactccgtctcaaaaaaaaaaaaaaaaaaggattcaagttacgctactccaaaatccacaatatggcagcttggtatttgagaagacagcagaagcaggatggtcactctcaccttccccttcccccttctcccctgaagcaggtcatgagactatcataccagaggtgcccttactatactggaaggaaaggaaaatttttacctctgaaaacacagggacacaggaggttctgcagaaacaggccttgctgtggtcaccccagtttattaccattcccctttgtccagtcatactggacatctacttttcctcaaatcagagcataaaaatacacacttttccctgattctttgggtcatttctgaaggctcctgtgtcatgtgaaacttatattaaataaattcgcatgcttttatgttgttgatttgtccttcattataggtgcctcagccatgaacctagcgatgggtgagaaaagagatcttttctcccctgtaagagtcaagtagattctaaaattctaaacaagcaggtttcgggttctcagaaaacagggggttgacaagaatggttctgacatagcccaaactgtgaaaactgaattatgattccaaggcaatagcatttaatactcatgcttgttgaataggcaagggcttccagaaggaagatcagagcctggtcttttcatctctggaaacctagatgtggtttactcttagaatgaaaaagggctaagtcttcctggggctctaaggactctccctgtgttgaatagaaaaagggataaaccttcaactgggtttgtaaaatatcgttgttccatggaatcaaattcaagaccaaggtcaaaagtgatggtcacatcttgctttctctgaccctacccaggatcagaaccagagccttcagctggcagcccattccttctgctgctgaaaccaatcctcaccagccaggcaattcagcagaagctcactcagggacagcatggaagaggcgtgagatgaatatcgctgctgccattctgttaaccggtgtgagctctagacttcatcatgattactatatttccttctgccttctgggattccttctgacacttgtttcagtttaagaaccatgtttctttctcaaatcattttccttatgctgtttcttcacaggaatgatacacttttctcatcataatttttgaaaatatgttgcaaaaaaatactgtgtgctatctgcagtgattattctttcctttgccttaaaaagaaagtattctagggaaaggatggaaaacaccacagaagttgtgagaatgggcatttgtgatttctaacaaggatttgtcagcctttgactgctctggactttaccagccacagttgctgaagacatgcagggtgaaagatcagcccttacagctctaaatcaatgaactccttaaacctgcccccaaatgtatcaggagctggaccctccactagcaggcagggtctgagatttccttgagcactcactatgtgcgagttactgtcctaaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacagcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaactgaaacctagctggtacctaagaattgcttctttctaaataaagcctactatggccacaccaccttcccaaactaaggtgctgaccgatgctctcctctccttctaccagattccaacctttagttattcatattttagtcatttcacttaactttacaacttcctcttgcccactgattttggaatagctggtttcctttcttgaagacttgaataccaattaccagggcagccctctagcctcctgtctccagcagttagctgctacagacattatgcttcttgtcagaggcaatgtgggtcatgctttacctctaaacagaatagccccctatctatgacatagaataggaaatgcctgcaggcagggatctggtcttattaatcttcatatctctaacactctttctgttcttagcacatagactattcttaatacgtgaatgaatgaaggaatgaagaatgaatgaacggctattgaaagatatcaatcttcattttcctttcccactgttaaaaatcaaagcgataactcaaatttccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttataatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacactagggacctcctagtgcatggggttaaatttcacatttgtgagcagtaagcatgtgtttgctggcactcttgcagcatactgggcatgctgtggaaggatcagagaatttttggaattgtgcactaaatgtctttgttctatacagttttaaataaatgagtcattttcagacttggagtttttctttaaatctgttggtataaaatcctattttctaaatgaaaccatactcaaaagtggaatatatgaaagagataaaagatgaaagtattcaagtgggttagggaaccttggaaagagcccattcaatccctcttcccatctctccctttggcctctgaggcaccttgcagaactttctagaatgacttgaatggtttgcatggtttgaattcgatttgcatggtctgaaagcctccagatctggagcaacactcatacttttcaggtgaggtaactgggatttaagaagttcagggatttttgcaaaatcacaccgacaagtaaatcagttgagagggaaggaaccagagtattttcgtagcaccaggtcttggggcttttgacttcaatttctcattgccctgccccctggaacagtgccactcaatggttcataggttgccagcatgagtgtcatcacctgggagctggttagcaatgcagaatcgcaggccttgccacagacctgctaaatcagaatctctgtggtgggatccagacaactgcattttcataagcttgccaggtcattcttaagcatcctcacccttgaacatctttcccgtctttccttttcttctggtcatgattcctcaactcccaagctcaaaagtagtgaaaatgttgttataaaggaacagaaaaaaaattaggagaggaatagagagtgaaattactccagagcctttattccctcacctcaggtcccactgaagtcattttggaaattatgtagctttttctttttcttttttttttttttttgagacagggtttcaccatattggcaaagctggtctcgaactcctgacctcaagtgatctgccctcctcagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgattttttttaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattattatctgactcttctaaaagtttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactacagaggactcttaagtattgtccttcatttagaatcttaaacaatatcattacatatgtccttttgattttcaatgaatacatatttacataaaatgtagtcatttctcccacttcttcattgttgaaattgccttcgccaacagctatgcagtgtcaagatgggatcagaatgtgtgggagcagatatttttttcagtcatgctttgctgacatatgcactgttaacgaattaccactgaaacaatatatgtgtctaagaaacatgtagaagagctggctgttaattcttatctatgcgagaagaagagaatatgagagtaagaagaacttggtttgttgagactcaactttggctaaattggaatcattaaagattaaaaacaatgatatctgggttccccacaaaagtctgatatcattggcttggggtacagctggggcatttttttaagcttccaagatgatgctaatgatcattagcgtcatttccttataggtcacctctaacctaaccacttcacagtagttaaatctggctatgatctgtactagctggtatctggttgggagaatcactagtactgggtttttgtatttctgcccagccaggcgttgatcatattttacattaggatttgcataaaagaagcaggccaggcagtggccctatgttcctttccccacacaaggtcatacataaaatatattattattttttattttttccccctctggccttttccctgtaagtatatgttatcactttgatacaaatgaatcataattgaatactcattcactcactccattcacttacttattcattaatgctttcattaaatatttattatgtggtaggtatacggaagtacaaaaaagtacaaaaagacctcacaaagcttaagatctaaacaggaatacaaattcatgggcaattgaaataccatatggcaaagggtaagacaaatgtactgaagtagcacattgaaggtgcaggagatccggtttgggatgttcaggaatctatttatgaggtgctgtctgaaaagggattattaactagctaaacaaaggtgatagaggagagacagattgttcctaggagagggagccatttgatggagggccagaagcaagaaacaaagatattttatttgattgtagagttcagtaaagagggataaggcttgagtggtcacacggagtgagagcatgaagggccatgtaagtagtggaatgctagtaaatgtcaaataactggctctaggggagggcagtggcgctaattgtagcatttgccaatttctgtggtgtaagtgctctcacaatagctgatttcaagcaactaacttgatgtcattgaatgaagaactcagtggaaagagatacacataattggctcttggaatgtgttaattagaagataagtagttagcaagcagagcatgtgtgtactaaacatagatagtgagggatagaaggaccaaaagatacccaatattcatgaggcacctgggtactaaatattcataatatgctaaatacacatgagaccaaatatacaagaggcactaaatattcaagatcaaataaatacacatgagcacttaatgttcacaaggtcttaattcaggcatccataggtgatacctattccagcaccgtaagtcttctgcctgagaattacatggctagtcatcaggctattttggcaagttacagctgtggccatgcattcttgtctctgtgtctctgataaaccacatgccactgaatcaggcaccacccattttggactcccttgttgggaagtcaactttggtccttgtaagcacaccataattgggaaggctgatgcaatacagagacagacaagacatataatgttgtgtactgcagaattcaagtactctaatcttcacagtctgcttacactctattctaagcgtgttaacttagcacatatctttcccgtttgcttctcactgtgattttaataaactctgtgattcaagtattttaatttggtctatgagcctttctgtttcatgatttggataggctgcctggtagtatacttgaaggccatcattgcatttaagtaattccccagatgacagaggaagtttatcataggtgaaattttaaaagatttatgataggtgaagtttaaaaaaaataataataattggccgggcgcagtggctcacgcctgtaatcccagcactttgggaggccgaggtgggtggatcacgaggtcaggagatcgagaccatcctggctaacaaggagaaaccccatctctactaaaaatgcacaaaattagccagacatggtggcaggcgcctgtggtaccagctgctcgggaggctgaggcaggagaatggcgtgaacccaggaggtggagcttgcagtgagccgagatcacaccactgcactctagcctgggtaacagagtgagactctgtatcaaaaaaaaaaaaaaagaaaaaaaaataatagtaacttaaatttttcaagggggaaaaacacctcggagttgatgaagatcattcgttgaatttgcttaatcatttgctacattttaaagaatgaacttgacttcctgtgaagtgaaaaaagcaaaaaaaaaaaaaaaaatcttgaaatggattgacttctgaaatgatttgtgaggccacatccagaaaggaattgagaaaaagtctttaaatatatgatcaaagaaatgttgaattaaaaaaacccaagcatcatattctgatgacacttgctcattttcacacgttcgttccaaaaatattaaaaaacacaagagatgaatcatttgatgacatttaaaacaatgcaaaaataaatttagatctaaagtgtcattgaaagacctaattggattagaaagttaatatttaaataaataatattcagaaacagagaggattatgctctggcctttatttcaatgtatgttatcagtaaatgccactataaaattaaatatgcaatttggagaaatttaatttaagtttgttgggatttatttactgcccatttgtttaaaggcattctgctagatactgcagggggctacgaagatgaaaaatacattctcaggactttacagtctaattacaactatgaagaatgttctccaaagctctaaatacaatttagtacaaataaagtacaaataaaaagctaaagaggtttgaagaaaggagaaacatagctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacattggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaaggaggggaaagagaaagggtagagtgtagtagaagagggggaaataagattctaactagcacaatgaacagatttgagttacatatgtacacataaaatcggcatagacgtgatactcacatacaaatacagattggaaaaaaaaaaaaccccactgggctacgaggagtggagttgccaccattccctgctatatatcccctctagctggccttaggtgacttctcctctctttcaaggctcctttagacattctagaatgaaaatattgcagaattggaatgagagaggcatactgtttgatttactctcttagataaagcctgaataatttcgcttataacaatgacagaaattattggaagataacaaagtgtcatgtgaattatctaagaaagataacattagggtggaatgaagagctctgaagagtgccaatatatgaataatacacattatatggagaaagccttttcttttttggtgaatacatgattgagtagaattttacgttgctggaaggtagagtttgttcttctctctatgcatatatacatggaactagtctccacctgagagcttatgacctctttctctctctttggtgttgaatatgtgtgtatatgtgtgatactgcagtgcttctcaagctgcaacgtgcgtgcagatcccttggggattgtcttacaatggcggattctgattcaacagttctgaagtggggcctgggatttcaaaattctaaaaaaactcccaagagatgttgaggcttcaatcacactttgcacagcaaggtgatgctcttttaagaaactgaagcaattactaacaaataggtcacataagtatgtaattataacagaagtgaatctgtgcacaaaagaaagaactatgaaagaattatgtctgagttatatgtgtatatatatatactatatatatgtgtgcgtatatatatatatggacatataattggcattattattactgtgatagaaagacctctcttctgcaagccaaattatctttcactttgttgcttcttgaattcttttcttcttttttcccctacaattgcatctccagatctccttgaaagggtcaagtagaatgcctatgggctatctaactatgttggtaaggagtttgaattcaatgacattcaatgcatatctaagccaagctgtcacaacacactcaagcctgccaaaggagttcgtacaaatctttaaaataatttacaggagagacaaaattaccacatcattcccattatcagaagaaataattcaaattaagaaaaattagaaataaaaatgaagagatgacactgaagaatatctcaccactggaagatgactttcatctacagtgatctctctataaagcaaagatacttttcagctattattcagtaagtgagtccaacagtttcctctgatattgtgaatttaattagtaggcaatttgctcatgaaatcagaatctagcccttcccttgctgggttgctggatctgtgtattcctatattcttctctagctattgcctcatttctcaaattcctttcatgtcttcatctccattccttatttccacctccctacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtagtccctgacactgccagccacttccttgtctttgagactttctccttgctcaggttcctagtcattcttctcctttgtagcctgccattttctggccacctgcttagctcctacaggaaacacttcataagtgttgttttctgttagatatcctgcctgagaaatcacacccctactcttgcataagtgggaaattcttcaaatcttaggtgaggaatgttagatggcttctcttctctttcaaggcttgtgcatgcagatcttttggggatcttcttacaatgcagattctgattcaacagttttgaagtggggcctgggatttcaaaatgccaacaaacccccaagttatgtcaaggcttcaatcacactgtatagcaaggttgacactgtctttaaagaatgatgcaattactaataggacacataaatctctaattattacagaactgaatctatgatcactaaaaaaggaaccatgaaagaaaagacattatgtctgagttatcataccttggctaaggtagtaccaagataagctcttcacaaagctgaatgggcttcacaatgatcagggtggtagaattcagtgggcccacaaactcctttgcaacttatattacggatagggacatttcaaaatagacactcgaacagacagtgccgtgatctgtaagggttcaccaatatgtgcacacttaaaacttatacccattggctgggcccagcatttagattggcagcaagaccaacccctcctctccctccacctcctcagcctacttaacgtgaagataatgagaatgaagacctatatgatgatccacttccacttaattaatagtaaatatatttttctcttccttatgattttcttagtaacatcgtattttctctaacttactttattgcaagaatacagtatatattacatataacaatgcaaagtatacgctaatcactctttatgttatcagtatggcttctgtcaacagtagcctattagtagttacgttttgggggagtgaaaagttctacttagatttttcaatgtgttgggctcagcgcccctaaccctcacattgtttgagggtcaactgtataacactttccaaaggctccctttgccctgttcttagacacggcccagcatgaatttgtggcaatcttgtaatgagccacatactgtctaacaagttggatgctaattatacaaaacttttgaaaaaagggatcaaagttcctacttcacaagcttgaacagctgtagcctcaggaactttctccagattgagggcaaaaatcctatctccaggaagccaaatttgcagctgccacactctcccaaaatcccagttcacctcagggactgatggggagtcagtcatcatacttccttcccctttgggctgaaactgaaaaagcaaaaaacggggtgggagggtagaaagaacaggaagggaggtatcctgttcattggagaggtcctaaggaaacctggctggagtgaaaatctgctgtgccttaagcaccacccttccatccccaggccaatacacatcatattactctgttgtcctccttcaacagtgctagttacagactcaagtttaccattagtatataatagctataacacttgtccttaaaatgcgggttaactcaatgctgctgggcatcaatctaaatatattaaggtaggcactactgtactacaactctaataataataatcaataactatcatttattgaatggccacatggcaggtactatgcttatcagggcttccctgtctgctcagcccatgtttctttgtaaaacacaacatattaaaacaacagtatttggagacaaaaatatcttcaatccaaccacctcataataaaaccaacatattcagttttctatattatcttatcgtccttgtccatatacatattcaatggttatatatttgcagtaatatttatattccaccttttcactttttgtgaaacttgatacattatttgttcctctttcattctcctttgaaaatccaaggtaacaaatactgataacctagtatatatctctccattcctccttcatggttatgtaatcccataagattaattttatcttttttattttaaaaatggaatatgttaattgaaacttgttttgatttttgaaagatatcatcaccattctttcaggacagtagacacagctctaactagactaaataataattcattctgggatgcccaaataattccataacatattcaataatttccacactgaagggtatttgcttgatttctactttttgaccatcatagacaatgccaaaatacacatcctctacatacagcctttcatactggtacttttatttctgtagtattgattctcagaaatggagtgactgatcaaaaggtaagtgcatttaaaatttttgtagatcataccacatttctttcctcaaagaccacagcaatttgcgtttcatctgcaatatctgagagtgctctcttccattaaaaattatcattcttaatttctgtctatttgttagatagacatggtgtcttatttctttattttcctatcccttactactatgaggaagcatattatcatagttttatttttccagctatctggatatcctcttctgggaattgcatattcctatacttcggccagttttgtactgggttgtttgaattttaaaaaatattaatttaattaacaaatttgtaggagaaatttgtatattaggtatatgcatctctttatgtcacatgttgcgaatacatctactctatttgctgtttttcttttgactttgtcttctgttattttaagcagtaacaaggtatattttttccttatagcttttgagttttgtgtcttgtttagaaaacgtcttcctcattccaagaatttttgtttttacatttaaaactttaatgcatttgaaatgtattcttacattgcataagctaggaggcaatctgtgttttctaagaggaattgcaaagagtgctggcaccatttattgaataaaacacctttattccttgaattaaaataacacatttgccatataatgtttccaaaaacaatttgtatctatttatttatttatttatttattttttgagatggagtttcgctcttgttgcccaggctggagtacaatggtgcgatcttggctcactgcaacctccgcctcctgggttcaagcgattctcctgcctcagcctcccaagtagctgggactacaggcgcccaccaccacgcccagctaatttttgtatttttagtagagacggggtttcaccaagttggctaggctggtcttgaactcctcaggtaatccacccacctcagactcccaaagtgctgggattacaggcgtaagccaccatgcccggcctccaaaaacaatctgatctgcttctggactctcaattttgcttcagtgatctacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaatgtccaagagtgcaattgctgggttgtatggtagctgcatgtttagttttacagaaaattgataaacagtttgctacagtggctgtaccattttacatttccaccagcaatatgtgaatgatccattttctccacatccttgctagcatctggtgttgtaactactttgttttagccattctgatagatgtgtaggaatatataataattttaatttgcatttctctaatggctaatgtttttgataatcttttcatgcacctatttgctatctgtatatcctttttggtgaaacgtttcttgatgtgtcttgcccatttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccatgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactttatttacctttttaaaagactgttttagttattctgtggcctgtgacttttcttatagattttagagtatgcttgtctatgtgtacagaaatccttgataagattttgatagaaactaaattaaacctttagattgatttgagaagaactgacatatttgctatgctgactcttccagtctataaacatgccatataatccacttatttaggttgtttttaatgcctttcatcagcattttataattttctacataccgatcctgtacatgtatgatagatttatacctacgtatttcatttttggataagcaattataaatggtgttgtgtttttaatttcacttttcacatcttcatttccaacatagataatccgtaagttgtgatggcttgccttatgattttttgactttatgatgggtttatctaaatgtaagcccatcataagatgaggagcatctgtatataaaaatgtgactagctttggtgtgttgatcttgtatttttggatcttgttaacctctcttctcagctccatgagcatttttggttatttttgcttttgtttttgtagaatatttgatattttctacgtacacagtcatgccatccacaaatagaaataattttattttatacttttcaatatgcatgctttattgtttttccttgctttattgtagtgtctggaacttccagaactatgttaaaaaagagtagtgaaattgggcatccttccctaattagcaatcatgggtggaaacattaagccttccattattaaaattatgctattaactgtagttttctgtagataccctttattaagatgtggaagttatcctctattcccagttttctcatagtttttatcatgaatggatgctgggtgttgtcagatgcttctgcatcaatcaatataatcatatgattttttcttctttagtttgttgatatggtagattacactaattaactttcaaatgttgagccagccttcaatactaaatcccagttagttatggtatgacactctttttttaaactttgacgcatgttatttaatattttgttgatggtttttgtctctaggctcatttatttattttagacctttcctgtcttctaactaaataatctaatgctatacattttattctcaatactgcttttatgacatctcactttatttttttttgccagagaaaaagactagattactcacagcaaagcagtagtcaaagaaccaacattttattgagccagttcccacagagtaatcccaaagaagttcaggagacacctgtacacacagtggattgcatcacaggagagaaaccctgagcttaaggaagcttaatctttaaaaatagacagtagatatgcttgccctttgcttcagaatctcactcatgttgatgttttattttcattttatttagttctttgtgtttaaaaaatttttctttgcaacctcctccttgacctggggaaaatgatttaaaggtgtgctgcttcatttccaagtgttttgaggtttttcttttgtctttctcttattgatttctagcttggtttcattatgttctgggaacatataagttgaattctctaaatttgctgaagttgcttggagtccagaatatggcttatatcagtgaatgtttcatgagagctttaaagtaatgtgtattctgctactgttgggaggagtgcttcaattagatcctattggttgatggtgttgttcagttctctttacccttgcttattttccatttagtagttctatcaactgaagagagaggagtgttgaagtccctaactagaaatatggatttgtctgtttcttttttcagctctattcatttttgcttcatgtatttggaagctctgttgttaggtgcaaacacatttaggattattatgtcttcccagtgaattaacacttaatctttatgtaatgtccctgtttgtcactagtaattttctttgcaatgaagcctactttatctgatattaacattactgctgctgctttcttttgattaattgttgcataatgtaactttttcgattcttttaattttaacctacctaggttgtatttgaaataaacttcttttagacggcatattgtgtgctcagcttttatcaatccactcagctaaatctcttttaattggtatatttagaccatttgcatttaaggtaattatggatatattagggcttcaatctgccaccttatttggtttctgtttgttttctttatttctcattcttctctttcttttttcttaccttcttgtgggttatttgaacatttcttaagattccatcaaaatttatttgttgtattttcttaacgtatcactttgtatagttttttagtggtctttccaggcattacgatacgcattaacattgcaatctactggaattgacttcaggtgacgtgtagaaggactcttacttccacttaggtatgtcttcttttaaaatataactcttaagtattttctctacatacattgagaaccacatcaggtggtgttaaagttttcacttcaaacttatggtaaataggatagtctattattttactctcatttttacccattctactattttctttctgaaatgtcaagacttcgttataatttcctttctgtttagagaatgtctttttgtcattctttaagagcagatttgctagcaagaaattctttgttttccttaatctgagaatgtctctttccctttaattccttaggaaaaccttaggagttatctgattatctaagagtctgtaccttagactttggttatgctattttgcaattctgtacgtttaaaagtcaatttgtggagggctgatggtgacacaaatgattcttgttcactagatgccagtaaaattttctcatggaacgcaatagattcctgccctacagttagtgatcagtattgtatctgttataaaattcctatcagcattctagagtgttttttatatatatatgtgtatatatataaaatatatatatacacatatatgtatatacgtatatatacgtatatacgtatatatatgtatatacgtatatatacgtatatatacgtatatatatatgccaattcttcagactctcctttgaaccaactgtaactaacatcttactaattccttcatcagttaatgatctaataaaatgttttacacatattcattttatatttttatgggactcacaattttgtctctttagaaatgtagccttatataaaatacagacataaaatgacccattaattcattattttacttacaaaaggtacctatgtatctgaaagttttctaagtgcctgacacacagcttcccctaatgataactcttctgtacgcatgagagatttatctaaacatttaaacaaacactgatacaacactattaacaaaactacagactttattcagatttcaccagtttttccactcatgtcatttttctgtttcaggatccaatccagaatctcctactgcatttggtccttgggtctttttggtctcctctagtctgtgacagtctctcagtttcttcttgttcttcatgaccttgaaacttttgaataggactagtcaggtatattctagaagtctcttaagatttgactgaagtattttccctattagaagaagttacaggttttggggaagaataccagagagataacatgtccttttcatgacatcatatcacaggagacatgatatcaatattattatcactggcgatgttatacttgactacttagttaacttggtgcctgcctggtttcttctccattgttattcctacttttccatattctattatctggaagtaagttaccaagttcatggaggggcttaggggaggattaaactctacatcccaggaaaggagtatctatgtatattattaagaattgttctataagggaaaattttctctcaaatatgcttttttactaaacagagaaaacacattattatctgagtggttgctatatggctaatctcatttaccttcttttgtcaattcataaactggtcttttttcccttttcgggccagtataacttaataggattgtttatcttatgttattaatttatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaactactgacttagataaatactccctgaactagagtcctggaaacctttaggtggccaagacttattctaaagaattgctaaaaattattttcttttaaaagagatgccgggaggagagagaggagcagaaaagataactactgagtagttggcttaatacctcggtggtgaaataaaatgtaaaacggacccctgtgacaccggtttgcctatgtaataaaccttcacatgtaccccacaaacctaaaataaaagttaaaaaaatgaaaagaataggaatagattaaaaaataaaaataaaagtgatttcacatataacaaatgtttcctatcattgcataaggcaatgctgcttaataaaagaaaaatttagtatagtagaatcgtgccgcagtcatgagaagcaacccttccccatttctcttaaccaacacaccttgaatccatcaaattaaattcttgcataagaggtaaccaccttcagatttctttcttagacctgtatctctaaaagaaaacatccttaccactttagtgcagactggcctggctttcaactatgaggatccacattttttttccctaatggctttagacatactctggacacaaaataatttttcttgccaaggtggtatgccagaaatgctaggaaaataattcccccgttggaagcagtcctaaaccaatgactagcaggattttgtgtataaataccccagctcccttgcccctttgaaagaataactaactcttaaacacatgtcttcaatccatttagaatttccccagtgggattaaactccactagaccagtggcagttggcttgataatgcattttttactgaatgatttctcttcacagtctcactatcttacctcacattcatctctgccttctgcagtagctggtgcttcacatttctaggacttcccaagttctaagtacttggaattcaggtttccaagatatgctaactcctccattctctgcatattcctaaattttttatcttttttattttattgtttttcctcccagatttttttctctttgtggtaaatatcattttaattcccctattctcattttagtgaaggttaaagagacatcatttttaaccagaactccctataagtgatctatggaaagaaaaaattagcaagaaaaagacatttgactagttgcatgagtcaagggttaagtaaaggagaggatgaaatttgtgataatttaaatttagctagtgggaggttgcaaacaaagactcctctctctgtaagctagaattctttatagccttaaatttcccaggtctagtttagtatttatatttattttcctcactacttttttactgcaaaatattcggaaaccatttgtaactttaagtcacacaattctaatttaatgattaggttaaagcaacaaaatttcctactaattttgtagctctataacactcagatattggcaatcctatatggctcaaactaatactttaacatattgtttatggacatactagaaattgtactgtgtatgctaacttctacactgggatctagattttgtacctctggatcttttctaagctgaataaatatgttcatacaaggttgtactctggttaacattctgtttatcaaaagacatgataatcatgtatatgaaacatgagaaaatttgaatcagttaaactgaaagatctacttagaaaaacatctacttcttctccgagtcacattcttgtgaattctggctttttaaaattatttttgaaattttagtaagattacataaaacagcgccatgtaaactataaaggatcatatacaaatgaagcacattactattagtaattataatgcaccaccagaaataagagatagaaggccctttaacctattttgactatgagacaggaggatagaaccaattcccccaacagccagggttcagtattattaataatgataataaaatgaatctactaacaacataccaagccttcacaatatgcagggcaccgtactaagtgctttatataagttttctcatttaatcttcacaatattaatctctactcctattcctctatttagaaaccagacctggagtgattgagaaacttgaaggaaaatcacacagtttgaaagtgacatagctagtgttcagaaacagagtctacactttcattactatcctccactgcaggataattccagtgcaaaggatgatctgtttgtttttttttttgtttttttttttttttgaggcagagtctggctctgttgcccgggctggagtgcagtgactcgatctcggctcaccgcaagctccacctcccggattcatgccatcctcctgcctcagcctcctgagtagctgggaccacaggcgcccaccacaacacccggctgattttttgtattttcagtagagatggggtttcaccatgttagccaggatggtctcgatctcctgacctcgtgatccgcctgcctcggcctcccaaagtgctgggattacaggtgtgagccactgtgcccggctgcaaaggattatctttaagttaaacatagaaataaggatgtaaaatggaatttagaattctgaagtctatcaacaaggaaactagtgctatgaaaagctaggtaatttgtccacaaatacccagtgctacctgcggacagagctagaaaagtgcccatatggtcatttacttcaccaccaaagtgaaatgcaccaaaccaaggggaaatgacttctctgggagtttaacaactctacttttttttccctcatttaattataacatggtctgttaacttgcaaccctctatttgatgtctcttcttttttcagtctttagcaaattccacatcgtatttggccaaatcagacataaaattaacatcaattcattctcaagagacaaaataaaactacgattttctaatcgtagttacttttctcctaatcttttgcaaatgtcaccttctctatgaaaatgctatgttcaaatgacctgtgtaatatttcatggctctaatgcaatcacaaaatatatattcggtatcaagatatataagatacatgttaataagtccctctaaagttgtcaaatttacactatcagaatgaaagattcctgagggctaaataaattttgtctctacctttcctcctcttttacaatgcctggtcttgttgtataaacacggtgtttcagtatcttcttgatgataatgaggtggatttggccaatctagctatttaaaaagtctgctctgttcttttaacttagttttgtagatgtataacaaaactagttatggaaattctctgagatttagataaatcattttttcacataaaattggtgctacagaaataatatgtggactataagctttcactattattgaacatttggccatatctatgaactattgagacagttgaaaaaaaagccacagctggaactatatcgagctcaactctgcaacttaattgtgaaataaatacaataataataattgtaacagcaggacctaaatcatgctggtgtaactgctgggtttgtcctcagatattaactctaaaggttatattcattgtggtgccacctgtttggaaagaagggcacatcaggattttgagtacatattttagagttttcctttggtactgtaccatataatatggaacactaaaatcacaataaaatgtgtctgctttgtgtgaaggtaagtaagtgccaagcttattgtaaggcatttcaaatcttggacacaacgccttttatatttcaactaatatactgggctgttgggctgtgctcatttttataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaatggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagtgtagtaaaattataagaatgatattctgatcacttaattcaaaactctttgctttctgctatgggactgttgccacagaaaatttcaaaaattacttttttttttttttaaagacagaaagcatcttgaatgagagggcctgactttgtatccctgttaatatgtacgttctcaattactccatagaaaccatatatgaaaagtttagttctgcttctttgctcccaagtctcatttcttactagcatttttcttaacatctggttcaatgttcacagcagatcagctttcaaatacttttttttaaaacccagaaattagtcaattttacatttacaattataggtcctttaggatattctaacaagtaaaaatcctaaaggcaaaatgtatgttttcaagtaaaaatatatgaggttgtttttttttgacagagtctcactctgtcacccaggctggagtgcagtggtgcaatcttggctcactgcaagctctgcctcctgagtagtgggactacaggcgcccaccaccacgcccggctaattttttgtgtttttagtagagacagggtttcaccgtgttagccaggatggtgtcgatctcctgacctcgtgatccgcccgcctcggcctcccaaagtgctgggattacaggcgtgagccaccgcgcccggccgatgagttattatatatagtgcttcatattatccatcactgttcctatgctagaagtcactcacaaaagctaaagagttggcatagctatttagcaaatataaacaaatatctgcttcctaaatattttaaagggttagtcattattaatttttacaaaatgtattgcaatcacattaatcgcaaccatataatatctttgtaatgtggatataagttattcaataggcattcgttgtgatattactttaattaatacttgttttttgtaaagtattacccgccttttgatggcatgtccttaatgactacccctcttttggtgagtgccagatcactattaattccttttgtattcattataacaacatcaatcagggaaagctcatttgctattaatgtgaatataacaggtaattccattctaatctagtagtgattaatgttcacttggtagtaattacaatatcacatttcagagtgttagcactggacaatacttattttgtgtggccttttaaagaaccacagcagcttgtctggacttagaattgaaaaggttaaagaaaggcaattaatctaaggacaaagagaaaggattcttatgtggctgggaaaggtgaataatggttaagtgaagggtttacaaaatttgttactattttttggtcaatcagtatgcttcatatgtacccagtaatatcactacttgacttgtaaaacaaagaaaactgaaatcgacatgtttaaaaagccactgttttagctccatgatgccaatgaattttcaaactacatggattccctgtcctaaatgacagattactatcaatgtgagagttacaacttatctttaaaagaaggggcccttttgatgttatcattttatttgtaaattagtaaaaattaaatgttctacctaattttgaaccaaaattgcctttatattgaaaaaaatcacctaaaacacatcgatgatatatattaatattatagctttattctattttaggtaaactatacaaacttccattaacatcaaccagagagactcccacacatattgacacaatatgttatgttagatcagagcagtgctagtcattgagttttaaaatcctggaaatattaaacttactggagaacattataggttatctgtaggcatcagagatttataggctatatggggtggaaaatgcatgtgaacctcaaaacaaccttgaagtataggcaagacaggtgtcattaatcttatttcacagatgcggagattgatgctgagagaagttaagagacttgccctaaatcccactacagagcatttactggaacccagggcttttaacttattttcttggtctttccactgcagcccatgccatcctgcctccactcacttgtgacagcctgtagagaacagatgtaagaaaaattgccaagagtttaggagtatccaaataacaaaaactatcagactattagggtggccaggggagaaagagaagagaggaaatcaggaaggctgggatttttcaaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaccacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaacagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttcttgcacaatcacttgctcctttgaaccacctaaatcgctgtttcccaaaatgtggtttgctgaacagtagtggtagggagccaatttaccatgttacacagataaacagcttatagtttaaattttaatattcatttagttttatctgtattaaggaaaaaaacactgcaacatcagactacagttttgtgggaattatcacttaaggctaaaagcagaaaacaaaatgagctgattttaagaaaaacattaagtaaataatagtatatgtgttattcaaaagattgaacaatggagcgtatatttgtttcctattgcttctgtgacaattttccataaacttactggcctaaaacaacacaaattgattatcttatagttttggaagtcagaagtttgaaatgggtttcatggattaaaatgaaagtgttggcagggctatactccttctgaagaagcttagaggacaatctatttccctgccttttccagcattagatgctaccaacattgtttggctaatggcccctttctctatcttcaaagccagcaggggctatcttcatctctctgactcccactctcctgcttccattttcacttatatgaaccctgtggttagattaggcccatctgaatagtccataaaatctccccatctcaaagtcacctgcttagcaaccttaattccgtctggaatattaattccctactgccagggagcacagcatattcacaggttctggggattaacatcttcgaggggcccatgattctgcctaccacagggggaaataaaacttgctttagccaatcggatattgcaggcttaatggaagcaggggctcaacaaattgtttacatgtttgcacttccactcttcacctcagccttcacaaaaaggacttgctcgggctggttagcctgctggagggatgttcaagatgtgagcgatagagctgtgttgacccagccactttcagacacttaagctctcagctaccctccagattcccaagggagcccagtcagagcagataaactacccaatgtaaaccatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctttctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaatactattgcagcatataaaatcaagctgggactttatgggaagctgcgccttgctaatttaaaaggacacactgactacatgctgattggcttggggggaaggattgcttaccatgttgttttgtttctattttaattttcacctgcctgtctgcgaattttccttaccatggtaatggatttaaattaatcaataaggtgttatgaagatttaatgtcaaatacactttaaaaacctagtttgaaaacttccaggtctatttagcacatgtcgtagtgtggcttaacccatggtgcattaacaaaataaaggtcaaagttaaattttagaaaaaggggaacaatattcctcacaagacattccagtgggataaaaaacacaggtttttttctatattgacaaacctagattcttaattataataactcttcctaatggtctatatctaatcaggtacagtggaatattaataaacatgttttatattctctggttatattgttaatggatacttcaatgcactgaattagaaggcactacagtgcatattgttttatcaagggcaagtttattttgcttcatctatgtaaaaacacattattttttgaaaagataacttattatttaagggtaagagtattagaatattaaaaattgatcacagaaagagggatggatagatgaatatgtaataaatcaagtatagtaaaatttcaatggcaaagtataggtgctgggtatacagatgttgaccgtaaatttctttcgactttgctgtatgattagccattttaatattaaaacatcgacaacaataatcctaaattgtaagcactgtatctttacatacttgtataccagtgccaccattttgtagctaattccttttctgtaaatgtgattattaaacctttaacactgaaatatctggcacatgtatacatatgtaactaacctgcacattgtgcacatgtaccctaaaacttaaagtataataataataaaataaaataaaaattgaaatatctgaaacaaagttttagggggcgtgttcatcctgtacaacttactgagagatttgtaatgccctatggaccagaggtctagtctgaagtttgaggttatttttaaagaaagaataagaattcgttgaggatgggaagttgggtagaaggtctttgcggcagatggaagtattgggacgtaaggtggataatatccaggcagccttaaattttctgccacatatatcactcaaggagagtggaagaaatggggccttggagagattatgtcatgtgtgaccttgcatgctacaccaaggaggtgggaatttatcttaaaggtattgaagaatttcaaacatgagtatgggggtgacggcatcagccttcatgtcagaagataactctggctgaggaagtgatgctagatgcagaaagaccagtgaacaagttaccggagttttctaggatacgaatagtaatagcatcatcatcagcagttatagtgactattctttattaattgcattttatgtaccttactctctgtatggtaatctcatttaagccctttagtcaccctaagaaacagaaaactttatgaggaaactgaggctagaagagatttaaaaatttgccaacggtgacaagattcgaatcaggtatgcttgacttcacagtgataagggcctgaaaccatagagaatcatagagaaaaatctgctttaagacagacttaggaggtaaaatttgcagtcttttgtgtcagtgtagacatatgcataaaagagagaagtctcaccagaatcagaagtttctagcttaaataattgggtagatggtggtgccatcttctgaaatagagaatagaggcagtaggggatttcagtttgggacatgctaatgttaaaatgtctgtggccatgagtaagactcaaaatatttgacaactgctttagcaaaagcccaaccaaatagagaaaacactactcagtacaccctacctgtgcttatcagcaggtaccagtcctgtggtctaaatatagaagttcactggggagttgcagatgtcaatgtagaatggccaagaggggtacataggcagcatatgctttgagagtcatctgcttatagatactaattagagccgtggatgaagatgagatcacagaagagatgtggcatggaaagtgaagaagtgctgagggtaggatctggggagcagccatacttattatggaagaggctgaggatgaatcatcaggaaagagactcaaatgtcctatggagacaggtcaggtgaaaacctggggaagagggtgttagagaactaaaggagaaaattacaaggagaagctgagtcaggcaatttggcagggggtaggctattgattttcttagtgagagcagtttgcctggcacggtaggagtaatagccagataaatggactgaaaagtgagctgtgggtaaagaaggtgagctaggcagctctgctacattttcttttctttttttaaagttctatgattaatttttattttaagttccgtggtacatgtgcaggatgtgcaggtttgttacataggtaaacatgtgccatggtggtttgctgcacctattaacccatcacctagagatatatatatatatattttattattatactttaagttttagggtccatatgcacaacgtgaaggttagttacatatgtatacatgtgccatgttggtgtgctgcacccagtaactcgtcagttaacattaggtgtatctccaaatgctatccctcccccctcccccgaccccacaacaggccctggtgtgtgatgttccccttcctgtgtccatgtgttctcattgttcaattcccacctgtgagtgagaacatgtggtgtttggttttttgtccttgccatagtttgctgagaatgatggtttccagcttcatccatgtccctacaaaggacatgaactcatccttttttatggctgcatagtattccatggtgtatatgtgccacattttctcaatccagtctatcattgttggacatttgggttggttccaagtctttgctattgcccatcacctagatattaagcccagcatgcattagctatttttcccaatgctctccctcccctcgccccaccccccgacaggcctcagtgtgtgttgttcccctccatgagtccatgtgttctcattgttcagctcccacttttaagtgagaacatgtgatatttgcttttctgttcctgtgttagtttgctgaggataatggcttccagctcctcaaagatctagaaccagaaataccatttgacccagcaatcccattattggttatatacccaaaggaatataaaccattctattttaaagatacatgcacacgtatgttcactgcagcactattcacaatagcaaagacatggaatcaacccaaatgcccatcagtgatagactggataaagaaaatgtggtacatatacactgtggaatactctgcagccataaaaaggaatgagatcatgtcctttgcaggaacacatatggagctgtgctacagtttcacaaagtttggccatcagaagagggagagaattgacactaggtacaggtggaggggtgaaggagcagcaccggtaagcttggacaattgtttgtttgttaaaatgaagggtaccagagtggtaagctgacagcaaaggatcagtaggaaggtgacttaaaaagtatagaaggaggagattcttgacagaacaaggctcagaggagacggaatttagaacagggtgttagcctcatactcttgcaccttccatatcctatagtcacacaatagccagaataagttttttttttaaaggaaaataagtcacaaatttattggctattttcccaactagaatgcaaactccaatgaggcgcggtggctcacacctgtaatcccagcactttgggaggctgaggtgggcagatcacttgagcctaggagattgagaccagcctaggcaactggtgaaaccccatctctgcaaaaaaatacaaaaaattagctggacatggtggcacttgcctgtagtctctgctacttgggaggctgaggttggggggatcacccgagcccaggaggtggaggttgcagtgagctgtgatcataccattgcactccagcctaggcaacagagtgagaccctgtctcaaaaaaaaaaaaaaaaaaaaaaagaatgtaaacatataaactccagagggtgggaccactgttagctgcgagggacccgacttgccgaaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaaattgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtgagcaatgtgaattctcaggtcctaccctatctgtaactgaatgtaaaactctaggcatgggaccattcaatctgtatttctacaagtcctctagtagctttgatgcatgttcaagtcggccctaaagtgttggatttataacctataactgtttctttctagaaaacaactatgtcgggggaaaaataaaaagaaagttttctattaattaaaaacgtagaattcaagagctaaaggaatctcaggacaatgattagcaaagataaatatacaaaggaatataaagtaaaaatgcaactgaaaatggctgaagagaacgtggactaacacataatgtttgaaacagagtatactatttaaaagctacatatgtgctaaatctcagaattcttctttccatgtgctagtttgagaggcaatttatttctggcacaactgccatatgcatttatactaatgtgaaagacttcttgtaatgagaaggtaatacactgcatttagtaaactagttttcaatgtgagaaaaatgcctacatgaaaatgttgccctttaaaaagcttcccttgactattcctgtttatattcttgatagcagaatagctttgggaaatgttctgaatagaatccaaagctactctaaagataggctgacaaggttgtcaccatacagttcctatgtaccatgaatcttagaatcaagaacgtttgaatcaagacatttctcagagccaatctgagatatgtgtatatttatatgtatctatttgagacaactctcagggaacaagacatcaaaaacaaattgatcaaaaggttatacgctcaaatgaatgttgcattttaacgcagtgagtaatggtacaatttaggaactaaactctttttgaaactgcctttcaagacagtttgcaattacaaaagaaatgttcatgggtatctactttttttatttgaaaaattgattgcatctaggtttaccattcatgcattttgttcaacataaaaatattttagactgacaaaaaataaattctactttcaaaatataaaaatttgatacctttaaagatgttaaaaaagaaaaagacacagaatagtaacaacaacgtaggaataattgtataggctcctaaggtgaccattaagaattctaacttacaggtattaagttttttatttaaaaaaatcagttgttcgaaggaaacacaatttcaattagacaggaggagtatgttcaagagacctattgtacaacatggatactatagttaacagcaatgtattatatacttgatacttgctaagagtatactctaagtgttctcaccacaaataaagtgtatgtgaggtaatgcatacgataattggcttgatttagccattccacaatgtatgggtatatcaaaacatcatgttgtacaccatgaatatatacaacctttatcaatttaaacaagataattaaaaatcagttgtattacttaagttgcttgttaaaatatgtatctgttactgtaatcaatacaaataattatgaagcagttcatgcatgctggcaaagccagtcaagccattcgtaagtgcctctcgttggcagtgaatgtattttttttccttggcctcctaaggcccttatgactttttctgggtcagctttgttaactcctctcacttagctccattctcaatggtcagcgaggcttgggattagtcattttcacttttcttggtacatggacctctctccccccgtactctcagtatttcaattatcatttgactgtagataagctcccaaatctttatttcagcttaatattctatcctgaatttcagactcacacagccaactgcccaagaatattccctgaacttgtccgccttttggatattccctaaacaggacacgtcctaaatcagtgttctcaaagcctggtccctcaccagcggcatcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaataacttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggctgtgctttccttttctgcctgctgaccgactctggaacttttttcctgcatggctttgcatggcgtagtatgtactcttcccttgagaactgtgagtaatcaaacttcttttaatggaattgatctctctatattgtcattcagtcatttctgtaaagcaaatccctgtgcaactaaaataccctgcccctcccaacataatctaagtcttgggttccctacttcggtgaaggtttctagctgtccaaaaagtagaaactttactttttccttttgtatattaatccattactagatagcaaagtctatgtttttttttttttttttcaacttggaatctattaacctctttcccccacttataccaatactccagtttaagccaccagtgtgttcaactgggcttcaataacttaacgaaggatatttttgcctcagtttatgcccttcatttcaatccaatttacctttttaaatgaagtcactcctctgcttaacacagaacctttagtggtttttaccattgtcatgcaagtaaaaaaaaaaaaaatctgacccttactaactttctagcttcatctctcccaattcaaactctaggtttaccaagcagcaatcctctcaaaatcactttcccatgacttcagacttgtgcacagtatgttgcctggcttagagaatactcctcatgtttccttccccctacctgaccaacccatctcttaggtctccatttagatgtcaggaggagcctttcttcatgccttcaggctcagctattctatcattccgggttctatcctatcccatttcctgctatctccctgacttattgggggtcctatttctgtcaaaatcagcaaaggaaagcgggtaggggttaggggaagaaggaactgggggtgagaaggaagacaatatgcatcaggataaaggaatgagctgttggcattcttagttgaaactctgaaggcattttccatgagtgtaaacgctataatcactttcacagatcaccttcaaaaatactgccatgtttgacctcttatttagttgacattgttatctagattgacatttattgacccattttgttttacttagtctcaatgtaagcaatgatatcttaaaatcaactgtttatagtaccggctatatttgcctaaaacacattaaatagattaaattaaattcacataattagaattttatgagagtgagaaattacttaatgggtacaatgcatcttattaaggtgatggataccctaaaaggcctgacgtgaccattacacaatctatgcatgtaacaaaattatacttgtacctcataaatttatataaataaaacaaataaactcaatgcctcccaaaataaatacataattgtcagagtttgtaaaagtatcaagccatgtgccatgtaataatattccattttcattcttccagtgggaagtaaacaataagggaaaaattatagatgacagataatgtatataggtatgtcataaattgaattagcctaggaaattaattataatttatatttctccctgtggcaaatgtatttcaaataccacacatcttaattgtaaactaagtaaaaaaaaaagactacttataatctagaaggcccttgataattgaaatacacttagcaatgaacaatcgagtttattttgctgattcacaattcacaagtaatcttaaggtcaggtttctgattgctcattcgtagttgttttccaaagtgttgataatctaattttgtttgtgctccaaatgattcttccaatgcaaaaaggtcccagctgctttgcaaaggtaggtaggtttgcctaaaaatcaagaacgacatcacccacaagacattttcttgttaagttgcgaagtaacttttagtatattttcagactagtgttttcctagactagtgtaccccatgcatgatctgaatcagacttgctcttaatcttccattaaaaacaagactttcattctagatatgaattttagtctgatatcttattcttaaagactactttcttatcacaaagttctcacatcaccaatatccaaaccaagacatttaagacaacattctcaggggtgataaatgactacagtttttgcgcttttaaaataggcttgggaaatgacctgtattttgcattacgtgcatcataaacttctaattgctcttacagagtgttctgtaaaaaagaatatccaccattctttaaaaatactatggcattaagactgaagccctgagagatgttaagatagactatttaaactctgtagactacatttgggaatgcttccaaggttagcagtgaagagtgactcatcagtgaagggccggaagttcttttccttttggtttaatgtggatctctcaaactactttctaatatggtaaccactagacacatatggctactgagcacttgaaatgtggctgatctgaactgagttgcgctgtaagagtaaaacttaccagattttaaatacttaacggaaaaaatctaattaataacttttgtaacaattacatgttaaaatgacaatgttttgggtatattgggttatatacaacatactgttgaaattaatttcacttctttatttttattttttcagtgtgcctactagagaaatttaaattacatatgtggctcacattttatttctactgggcagagctgctgtagtaaaatgaagagaacaagaatagccccacagatatcttagttttcattgttacaagccaacaatttattagacaattttctctgacttgaaatgacacaaaaatctcagagagatcctgtggtgtgagcgtttggagtcagaggcctatttttcatggaccattgttctggtttagtttaacaaatctactatagtgtaatatagtataaactatttttgcatttttgttcatttagaagtttatgaaagtcagcaagatgagcatttttgtgattgatgtatgatgcaataaattgcattgccaatttagaaatgtaataatctgaatttttgatcatcaagtttatgcataatgtatttttgagagaaaataaacacaagcaaagaatcaatagcatttccccagcccccaatcctcgggggagattctctctcattatatttaatttcctctttgaattaactcattttaaaagacagtaaaataggctcaaatgttttaattgtatttctgatttttttctgaagttaagagcaaagtagactgagtgaattgacagatggtaatgattttgcacaccatttatttcaggactaacggcaagttctattaaagtagttcctcctaaggagtttatctcaaccagtgaatttccattcagcctttaacacttgactcaaatgccacctcctcctctaaaaagccttgcctggtcctattgggcagttatccactgcatattctcctagagcattatgccttatatatatttctcttattgaatttctcctcgctgtcccaaactagagtgtgtgcttcctgacaacatggctgaagtcaacctgagtcttactaatctctgtattatcaatgactagtccagtgcccaacatataatagacatccaaaatgtgcatatattccaggtttctcaatgagatggtattaatattgccaaatattaggtatagtgtacttaacagtatgtctagttaaaacatacatatattctacatatatgtagtttaaatttctctagtaggcacagtaaaaaaaaagtaaaaataaatgtatacatatattctacatatatattctatatatatatatatatatatatggcacatagaaatattttaatgaggaatttgatgatggccaattttcaatgatttaataaccaagtcaatttttaattagagacaatttataagtaaaaattgaccttgaaaagtgtctcacacacacacacacacaaagacataatggaataataaaagaccttctagtcaccaaattaaatatttgtcttctaaatgcaatcacttcgattacgtttgctgaaaggattacccaaggctctttttttgctacaattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggtttaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaattgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgttaaagtgaaaaaaataaaacgtttgtctatataatgaatattattgtaaagcatattaaatgttaaataaaatcctaattaatatactaatataagctcttataaagttcaaataattaaacaatatttatattatcaacatttcataagataaaacacactaaataattaaaagctcttccaccatgcaaaaatgactaaacgattttttaatttctaaagctttttgagattactgtgaaaggggacatagtttcaggaaaggtgagtaaacactatattagactagcatttctcaatttttatactactgacattttggcctaaataattccttgtggagggctatcctatgcattgtaggatattttataccatatctggcctctacccactagacttcagttgtatctccaatccagtaataataattaaaaatgcctccagatattgctaaatgtccacttggtggaggtaaaaatatcccccgccccccattttgagaaccattgcaatagacaaattagctcagagttatgtcatctctaaacaacttagcataaacaaactagagaagccctttcgacttctggtctgaagaattctgcgtgtctataatacaagtttaattgatatgtacctaagttattatcagctgatataacaatttgtgatgctttctgaatcatcaaaaaaatgttgtttgaatgcttaagatgcttaatgtgttttgtaatacagtatactaaaaaccttggaaatcattaattaactgaagccatataattttgatagtttggttactgggcactttaatctaatctgtaaatcttccaatagatttccaaactcagaattttcatcctgctctgattggttaatctttggtgggatttaccatttatccattgcattataattatttgctgtgccttatcatataaagacaaaattgggtgtggagtagttgcccatactttccagggcatatcattgagacccacactcagtaggttattatgttctttaatggtttacacattgaagggaagtttcacctttcctgaaactataccccctttcacagtaatctcaaaaagccttagaaattaacaatttatttagtcatttttgcacggtggaagagtttttaattatttaatgtgtttatcgtattataaaacattgatcatataaatattgtttaattatttgtactttataatagcttacattagtatattaggatttttataacatttaatatgctttatagtagtatttgttatgtagacaaatgattcaaatatttgcctcattgttaaaagctcacttaaatgttttgacataagctcacataatttgaaaatattaagaatttgaagctatagaatttgaaaacattaatgcattgaattccatatggaagaaagtctgtttagttgagggacttcaatatgcttccattttccacttctgaagatctgtttcggctcatggtaaatattacatctttaccctcgctccccaaatgcttcagatggattaagcaccattctttttgtgtgggggagctggagagagaaatagatgaatatcttccacacccttgattccatcctaacaagtaccaataaatagcaacttctcacctcctctatagaggttgtcttcaattaaaaatacactagagagattataaccatagaaaggacattgagtagtgctttcggctaattggcagtacattccttccaaaatttcagaggtacctcaatttaatgactcccctgaataaagtaattggttgaaatttactttgcagttcttaatataactttgggcccatcattagcaagaactctaaaaaggaaaaacaaaaacaaaactggggtcagtatatatttaaatgaagcacaaggaaaaaaggtatttcactttcaaaggacctatgctgttttttttttttgaagattgcaactcatctattttataatataatgacaataatattgcctctgagttaactgtgtaataattcactttgggtactgcaataattgagcaaacagaagctggtaccagaggcattcctttcttttatttagtgtaatattttttcataatttaatgagaaacatttcaaaagcaacgtttttatcctttcatgttaaattaatttacaatgctataagctataataaaatgagagaaaccatcagcaaaaagcaaaagttaataaagacagatattcttaaagtttcaaggactgaaaaaagctcaaatcacaaaagtatttggtttctcctttttttgtggcttggttcaatttgtcataatttgttctcaattattttgtacttacagctagcataacataatattgatgaaggagaaaagatgcattactgaaagtaaacatacataattaaaatcacctaagaaacaacaaaactttgcgatgtacttcagtaaactactctaagatttatacaaagaaggctatgatgtaatttaacatgtactggtataaacttctttgggcaaaattcaaaatttcaagcgatgatgaataaagcataaggaaagttcatgttattggaatggagttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataatcagttggaaagataagatttaatcaccaactataatcagtatggtgtccgcagtagaccactttagaatggccctttgttgaaactctctcctctctgcttcttacttaataagcttttctggttttccaattcctggttttctaattcactgtgcaagacaaattttaaaaagagaaatcaatgttggctgaaattaatgcagaatgttctgtggaagaagaattcaagatgggtcttgaagcagtagtagaatgtataaaggtgaagataaataaggaagtcattttaagaataccactattgttagtattaataataactccaatcattttatttctaataactggtactgtcatgaaagatgatctgttaataccacatatcagaagggttttagttcagccccagacatgatacattgtgtttataagttttctttcattactttggcaaacaacgtcttttgattttaaccttcctttcaatgactaagggggactctaataagtatctaggtagaattgtcaaagaagatgagtcagtatttacatattgactgttacaagcactacacaaatggttgttacataacatacttgaaatgaaattagagttacctacgcaaatatatgtgtgtgtatcttgtttttttttttttaattgagagagagagggtctcattctgtcacctagactggagtacagtagcatagtcacagctccctgcagccttgcagccttgacctcccaggctcaagcaatcctcctgcctcagcgtcctgagtagctgggattacagaggtgttccaccacatccaactattttttaaaaaatttttttggtagagacggagtcttgctatggttcccagactggtctcgaactcctgggctcaagcgattctcctgccttagcctcccaaattgctgggattacagtcgtgagccaccttgcctggctgtgtgtatatcttttaatgttaaacttttacagtagaaatactcactatttgcttttcaattgcttgctctgaagagcacaatgctttactgaacagagatcaaaaacccacctagttaaacaggaaataagactaataaaaatatttaatggtcttatttaacaactatagaataaaactgaaaacagtacagtgaaataaagaaaattcctttgtaccaatgtcactgcatgatatcggtactaaacaaattgttctcaggagctacaagtcatattcaggtggtcagaaactttaccttacacaatgagaaatgtagtatctgaaatatctgcaactagttaggtttaagaaaagaaaactcttaccattgggggaaaataaatccttttagaaataggattgaactgtcaataaagctgtttataataaattcttataaagtttaacatgaaaggactgtaaaaacagatgttattcaaaagaaaatcacatctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgagaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaaattatttcttccctattcatggagaggatatgattagaaagacaattgtatatagttttaataaaatctatttattttggttttgtttaatgcaattccacaagcttttactgagtttgcactatcttgacactgaaatgctgaagacattttaaaaattacagaatcactcaagaagcttaaagtttagtggtgtgttaatttgcagatgatttgattctgcttttaacttgtttaaggacagtgatctctgtttaatgccacactgaaagtactatgtgttcataataaacaatttctgaatgatcttatgagctcattagtatgtctcatgtggtttattgctttaaaatctcataatcaactatggtcatttttttctgcactagaatgtaggtcactgagctcaaatttatttcttatttttttttgatagggtctcactctgtcatccaggctggagtgcagttgtgccattatggctcactgcagcctcgacttcctgggttcacgtgatccttctacctcaggctcccgagtagctgggactacaggcacatgccaccatgcgcaggtactctttttgcattttttgtagagatggggtttcaccatgttgcccaggctgatctcaaactcctggactcaagtgatctgcctgcctcagcttcccaaatccttgggattacaggcatgagccatcgcaccccaagtgtatttctataccttacaaagtaccttacacagtaactaaccagcaaatggcagatactccagtcatagatgaatggatatgaatctactgttgaatactaatagaaattgtaacggcacagttacatttctgaaccaattctagaggttatacattcaaagaaggagtattattattaggtgcctaaaattgttagtaaaatagacctcttactatatttatctggattcttatatcatgcaagaaaatatcaataaacaagcatgccaactatggttttttttttttttttttttttttggtatccctccagatccagatccattttcccttctttttccaccttccagggggctgacttggattacatcattagactcctatgccctatggttttctgtttgggtttgaccaaggagaggactagcaaaccactgcagagaagggagagtcttgggtcagagtattgattcccttcatctctttttccctgagtatcatttcgaggcaaattctgtccttaagagaaagccactgctcctcccaaggcattaaaatctgcatgatgttttttttttttttctttttttctgggctctgagaaacctctctccccaacaacggcttcaggtctaggagaggtgacagctctgctgctgctagtcctagagtcttgtgctatcttgtgagatttccctacaccctgcccaatcctgagtatgtagtgccttgtaaataaagactcctcaacttaccctaatctgaatgtgccatctgtttcttgttgggactctgactgactgagatatcaacacaaatacaatcatgaaacaggacacaaattcagcacttcacagagttattgcggtactatgttaatgggcatgaaagttatcagtaaactgtaagtgccataccgatgttgattgctatcatttagcacaaactatgaaaagttcagactatgtccatacacaggtgtctcaacacaaaaccagttgacatggtctaacttgatataggattgatgtggctgtactgtaacagttgtccaataatcatgttgtaaataagtttttaatatattaacagcatactatattgatacatatgtaatcacagtgttatcagacttatccagtgttaatatggctgaccatagacaaggtctcaatattccattatccgccagtctgttccagatcgtgggccacttgtacatgttcctagttcggaatcaattaagagactagctctgtgaagagacgggaagcataacctttttctgagttataagtataaagtcagccctgcattcttttaccctgattggggctgagctacattacaaatctcctttgtctcttcaagcttaggggagcttgcaggaaattttctgttaagaatttatgtttttatgaaaaacaatgatactgagacacagagtgtatgctacgaaaaaaataaatacttttagggtaaaaaaggaaaaaggtggtattaaaataaattttcccaaatactgctctttatatatttcgttagtgacatctacacaataaccatattttgggaagcaattaaacacctcacatggacaaaaatcatatcggtttcttactatttgggctggcagtaccttataaaaagaaaaaagcatcaaggcactgtagtatgatatttttgaggatgtttttcctataaaaatcttcaaatgagctgcaaatggacccaaacagacttattttaatatactctaggaccatatataataaaaggtcctatactattttatagaaatggcttctgttgccttagatgaggtttacacataaatcttttaacttttagtgctgcttgtttcacttctggtggattctttttacaacaatgccctgccaagcagttaatactacttcataaaggaagacgccaccccttgaccttcacgtttgtgacccataatgcaaggtgcttccatcatctctatcttttctagatatcacccttccttggaagtgcagacaagtgttttgtttatttgttcttgttttgtttgaggtcaattcactggctcctttctccagtttttttttttttttttaaacaccttgaaagcttctaatacatctgctagccaaaacagtcattttcattacatgcttgtggctggtcaaaaagaacagttgtataatttttattttcttacccagaccacaaacaggttataaaaagtacatggcccttaaattttggcggttcctttaaaatttagttcaaaagccaacatgaagagtcagatggaatgactgtcacatggaagagctaccaagcagataataagtttagaactcttaattgaaaattaacacacctacattgtattcccaaattgaagaaaacggctgttttggctactgctataataagatgctgcatacttcacatgctgaatctggaagggggagcaattcagtcctatctgacggttgttcctaagctttagtataacttcaaagatgagggtatgaaattccgtcatcgtcagagagatcctgctttctcttccttgggttgcaaagttagtaaatattagccttccattttaactaactcgttgagcttgtctccaatagaagattgaattattggcctcaatcctttcacatccctagtagtatcatacattcacgctccagccatggcctcacataggtggaaagtattttcctaccccttgactttgggcttggccacaagacatgttttgtctaatgggctataaacaaatgtgacaagaggagagattttgaaaagtgttgtttgtgcttctgtcattgccttgtgctactctgtcataccccgagtagctgatgtcccttcagcttgagtctcagaagaaaatatgtggtatagacccgaacagaaccgacggcctagagataagcatagctaaaccatttccagccatgattggccaaaccctaccaaactgcagctccatgaataaatcaatattgttgttattagccactgaattaaatttttttggttgtttattgtgcagcaaaatggactgatatgaactgaaatgtggtttataatcaatacaatccagtaaagttctactaaatgtatgtctatcaagcaaaagaaaaaaaacagatgattagaaagttgtcaaattcttctaacaaagtccatatacataccaggtaccagaatgagttatcaataattgcctaggggtaagggttagaaataaaaaaagtcaagttgaacccactaggtcgtatttccaggttttcaagcagactgttctggtttgcaatatttgaaaagagtctgctgtggtatgctaatgactgtgaattctgtggtctttggaatagttccaaaatgctaagctcaagtttaaaacaaaattggattctcaaatatctttcttgctcagaaaggatttaagtccttttgtacagaaaggaacaaacaagtgataaggtaccttttgggctttctattacctatgtttccagagtggtaaaactggatctctcttgttttcagtcatatctacaggttccctcctaaggatgatccttcctggtggcttctgtttacaacaatgccacgccaagcagttaacactacttcgtaaaggaagactccactccttgaccttcgcattcttgacccataatgcaatgtgcttccacaatctctatcatttccagacatcacccttcctgggaaatgctgacaagtacggactgtgctaaagggtggaggctgtctttcacctcctgccaccaacagcttatttgaggagagtttaagaaagaagattttaccagaaaagttccaatttcatgtgcctctttatatgctttttctgcttcttatgtagtctccaaatttgaatgacagtcttcctaactagtaaccttggaggaatataggagaccaagtgaggaagctatcaaataatttcttaacatcaacattattgaaacatagtaactcattgttttacattggaggctaaatagaatgatatgttttaaaatggctatctccatgggcttattttttttttctcatctgataagtggattcaatgatttccaagattttgttttcaactctgtgattctatggtctctggatactgtagttccaaccttcaagagaagagcacatctaattaaagttcgagacagcgccaaaagattagcagctacggtcacatttaatgagcaagtcgagtgaaggcatttttcccattgtctaggagtcacctcaataggatggaagatgcacgttctatacagtcttatgaccagcctgttcctcagcatatttttcctttaagtaccaaacaggtatatgaatttagaatataaaaagagggttgtgataagttgatattttcttctccaaagtttaaatatttgaatagttcaccagctgtagctttaaatagtgggaaataatgcagctagaagaaccatacagggaaaaagagtgagttgaaaattctcagctcagtggttatcatcaagtttggttcctgtcagcctccagcgactgtaggtggtgcttataggtattcatcaataaaaggtgcatttgaggggatttccagcattttgcttcggaggaaatcatttatgtcaaaagattaaaactgctgttttcaattgcttaattgagtatatattgaggttaaggttagtgaaagtggtaaagcagaatgaatacattgcttattacagtcaagaaatgttatacagaaatgagaaaatgtacaaaccccaccagccataaataaggaagtggttagaatgtcgctctcagccaagggccctaagtccctttgtgtaggtttggaaaaatttatgcctgtctagcagcttgtagctgtggagcagagttggctgaccaaactttgattccttctctgaccatgttctgctagccttatgtccttcagtaaatgacagttgccataaaaaacaatgaggttgttgtatactccatcattcccactactttgagatcttaacaagatcacataaccatctgaacttgaagacacagactgaattcaaataattcaggctaagacatgtgctgataacctaagaaaaattattgctagactcctaaaataaatactatgagaaagaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcatatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaaaaggcatgcaaaaactattatttaaaaaatctcttttcacagtgtttttgttttgagtactatagctttgtaaacatttaattatctagctttatgggtttcgttttaatgattgtgccaacaaatgataacaataaatccatgccaattttggaagtatttctaatattatataacaaattggaaaggaattttgtacatgattatctctaggaagacaaaccacaagagtaattaacagagctatgattccattatcatcacaagggttaaaccagaagttcatgttcactattttcatatatctcacaaacccaagtatcagttcagttctcctggaaattcatgaaggattaaaacaaaacacattattaggcaatattttgatataaggagtgggtagctaatatgttttccaaaatttagtacagaagtgtgtgtatcatctcaagattggcggtaacacatgttacttacaaaaaaatgagcagaaataaacagtgtgtttatgatgtataaataaaatataatgacatcactagacaagggaacatctactttttggaaatttatttagggcagtgaaccattaaaaaataaaacataggctttatatttttatcatacagatggctaatattattaattttcaatatgcatttaggaaaaaccaaagtatatttactatttcaattagctattgtcacagtaatgtagaataaagctcaatggctttatgcaacaatcatttcttttcctggatgtgaatggctagtgcagccctgctgttcatgtcttttatcgttttcctgagaccagcagcctagatggacgtgttctcagaatgatagcagaagcacaaacaggaatgtatagatctcttaaggcctaggctgaaaactgtcacctctcactcctgctcatttaccatttgctaaagcaaatcacatggccaacccctaagactaggggttgggaagtacattccactcataaggaggcattgttaaggttgtgattgcagaaggtggagaagaaatgggattaatgattaaatctactacagctacataacagtttctttaaagcagatgatatattgtggaacatgacaatgatgtgtacttacttatatctttgactgaattcttcagggtgtaatttttgccacaatatttacccgtgctagatgattgttatgtatttttattgttatcagtgattaacctgctgctaaatttaagaaatagagaatcttactttttttttccagattcttgtataaggaattaaaagacatattttactggaggcaatcctttaacagcggatgtgagtataggcagactgatgcaatgtctagtctagggagcagagcatgccatctgagtcacgagtcttgtcttactcaactctggagttacttacttgaagagcatatactatatgggaattataagacaacactgcccctaaggagtttgggaaaattattttcttttccaatacaatatgcaagaaaatatttcacatcatgagatttagtcacttcctgtaagacaaccagagcaaaaagtcttcttagtcagatacaccatgtaggcaaactactctctcatcacctgtgcatgcacgtgtgtgtgcgtgtgtgtgtgtgtttgtgtacacattctgtctgtttccaattacaacttacttttctcatctcgtctttcaaattcttgtttttctggtggtgttccatttttgtaaatagaaaagtaaaagaagagtgtgcttaaaaacctgctcagagggtgaatttcaaattggcgtctctattagaggactaatttgctttctatgtgcaatcctggtgtgatcactgttgcatatgttactggatttcaactcctctgcccctacctaaactcattttgagactctcacatggtaggtcgatagcctgagttttatggagctcaaatgctgacatgacttctgtcagacttctggtgtcacatttggtgaagcaccaggagaatattctaccatatttctctttcctttgtttcactaggccagagtagtcctctctcccttgggttatcagactttacacactagcaaagcatatgattggcatttttctcttgcttattacccactccattcctctctctctgtctctctctctccctctccttcccattctccctctgtccttcctgttctccctctctcctttctatcctccctctctccttcacacttctcttctcctctctctgtctctctaaaatcaactaattattttccattttaatcacattcataagtcaatatattttatgtgcaaagaaatacatattcaagaaaaaagttcaaataagtaaaacgacaacaaaaacctgtttcagaataaaataatcttctttgctagaactaaccaagttctagctggtgtctttaagacacaaatttggctagaaagttactaattaatttgtaaaatatacctgaaggagttgtgccttttacgggatacttagataatctattcaccatcagtcaggggtgggtaataactctctgactactcttctgtactttttatcttatatacagtctttcagacagaatctatttcaatacagtaaacacacatacacattccaaatcaaatcaaaacaaaaccttttttccttctcttgattaactttacttttgagaaattgattataatgaaacatgtttaacaaaatgcatttttatgataaagagaagattccctaaatcaagactgagacataattgtgaaaaattcagccagtattataattggattaagttatgggattcaacctgaaaaaagaaatttttattctgatattgtaatttggtcatattaggctaagatataatttaatgtcatgagtcattagagtgtaacattgtactagtgatcatggctctgatggaggcatggacagtttttatgcaaagggaaaaacatgaaaatggtaatggaagcctttaggtgtcatctggcttagcttttccttttgtatcttcaaaacagtgggaagaataaacaatactattcttgattggctagccactggagatggggataccaaatgaaaaaaatgctccaacacaagcaggaagtattattttcttcatttctttatcctgcaaaagcacagagactctgtcttgcagaatcatttttttttttttcaaatttcagagctgaaagggccataagcaaaacatctggtctagtggttctcaaatttaagtgggcacaagaactacctaggggctctttacatatgcagattccacgacccatccccagagagcttctgacacaatgcatttttaataaagtttccaagtaaagatggtgtccgtggtatgtaaacctggagaaacatatcttttacctagatccatcatttttcagaagatcaacctgagatctccaacagcactgacttccccaggattacagaggctagtgtttaggaacaggaccctaacttcttgacttaaaataagatattttgcactctctaaataccttaatacttctattaaaaaaagttttagagtctgttagctgaagaagctgtgcctttttaaggatacttaaaagcgaataggcttttccccatttttgtattgtggcaaaatatacacaacataaaattgatcattttaatcatttctttttgatttgggatcttgaccatgctggggtacagtgtcattcactgcttcctccagttcctgggttcaaggaatcctcctgcctcagcctccagtgtgtctgggactacaagcatgagctcccacacccagttaatttttgaattctttgtagagatggggccttgccatgttgcccaggctggtcttgaactcctgagctcaagtgatcctcctgctttagcctcccacagttctgggattacagaagtgacccacaatgcctggccatttagcctttaaattttttttatgggtacatagtaggtgcatatatttacggggtacatgagatattttgatataggcctacaatgtgtaataatcacatcaggataacggggtaccattttcttgaccatttttaagtatacagttgagtactattaagtacattaatattatattattattatcgttgaaccatcaccactatccatctctagaatgttttcatcatcccaaactgaaactcaggtactcattaaacaataagccctcattctcttcttcctccagctcctggtaacatccttcaactttacgtctgtataaatttgactgttgtaggtagctcataccagtggaatcatacaatatttttcattttgtgtctggtttatttcacttagcataatgcctctaagattcacccatattagctcatcttttgatttgctgaattcttttaacttcttgttcaagatgatgttctggctctttaagaaatgaatttctatcatttgtccaacttcaatagatagctgctaaatgagagaaagcattcagaaagggcattcctgggtgaatgaaatagacagagcctggaggccggcatagtgatgtgaaatgcattttctacttagttgaaagtcacttgaaaagaaaaagaaataggaaataagagagacaggaggagaagagaagagagatgaactaaactgagaaaaactaagactttcttaaggctgcgctgtgctcagattagtagggctatgcaaatgaggttattaacaggtatattctaaatattaattggtacacactggtatacatggaacccgatattattaaaatacctttggggcaaactatagacaaagaaaagcaaataaagaagtgaaataaagaagtaagcatctatgttgctattcgagaggtatttatcgtgcttaagatttaattttaatttatatagttactgtcatgagcattttgcagcttttaagtcagaagggaagttatttaatttatgttttattgtagaaaaaagtttaaagttttaaaaacatcagtatactggtgtatctccaattgtacacttagaggcaaggcctggtaatgctttcgagaagaggtagggctttggccaagagttgaattttccaggtagacaaggagagaaagggtattctgagcaaagataacttctcttgactgggataatgactacttgctgtttagtattcattcagctcagtgtcatttataagaaactttgtatggcagctttaattaaatggcatcaaaactttttgatacttctccatggaaaggtggagtttatgttctcatccccttgaatcagagctctgtcactgattgacaaatagaatatgggagaagcaaaaccattcttgcttttagggcaggccttgagaagcttgcagctttaatttcttgtcccttaggataattgctcttgggacccaactcttacactgtgaaaaagcccaaactgctccatggagaggtccacatgaagaaaaactgacagtcagcacctattttccaggcatgtgagtgagccctcttggaagtgaatcctccagcatcaggcaatctaccccaactgatatcaactgaaacagggataagcaagccccattgaaccttgagcaaactgtagattcatgaacaaaacaagtaatttttactgaagccatgaagttttgggctggcttgttatgtagcaaaagttaactagaataccttctctgatcttactcataagggatgcagaaggtgccccttctcttggatgactaaaggactttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaatggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttattaacgttatctatcagtcattggtgtgatttcctgtgttactcaggatgtttgggaaaaagaaactccttttaccaaactgtgtttcaggcaatctcaactttggtgtctgattgaaagagaagggccaagtcaatgtattttcccaaggagggcattatgaaagataaaatatctctcttacaattttcagtataatatgtttgttatcatgaatgagggtattcagccttgtttatatcccaagactttaaagagcttttccaaaacgagtcaatatgaacgcttaagaactaaaatttatggaagattaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcagtacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaagattcgaaaatggctttccttgaaaagtaggtaatgtttgggtaagcttagatgaaaaaaaggaatctcaagacaaaaaacaagatcatcgaaagacacagaagtaagctggctagctgttcattttagtaggagttgaaggtgcattgagaggtaaaataagaaataagattggaaacgagactcaggggcaattgtggagagccaggtgaaggagtctgtagaatattctgaagggctttgaagtcaaaaaaggtgtttgaagaggggagtcatatattattttcgttcactgacaaatacttattgaacacttttcatgtgacacacacagtcttggacaatggatatatacaagtgaataaagcagatgaaatctttgctctcatggaatttgcattgtagttacaacctaagctatgttttaggaagcttaatttaaatggaaatctgcaagttggattggagccactggtgggcaggaatgagtggaggagggtaaaaaatagtaagagtgtgaatgagagtggaggtaaggggctagtgagaaaggaatggtcataaagaattagggaggcagaatctacagaccttaaaaatgaacttgaaagtgaggcaagtaagtgggagatttagaaatgactatatgatctgaactctctgactgaaaagatggtaccgggatgaacagcaggataggaaataagacttggtataaaaaatggcctatttgggtcatactgaatttatgtcatttgtgagacatttgagtaagaaatgtcctacatacagtaagaaatgtgggacagacattggaaaggaataaaaatgttcaaatcattggattaaaggagatggagaaaagactgtttctagtataataactaacacataactgacagtaactattgactaaatatcaaatgaagataatgagattaatgaaatcagaaaagaatgcatagaattgatactgtgggcttggtgtggtggctcacacctgtaatctcagcgttttgggaggccggggcgggcgcatcacctgaggtcaggagtttgcgaccagcctggccaacctggtgaaaccctgtctgtactaaaaataaaaaattagccaggcatggtggaaggcgcctctaatcccagctacttgggaggctgaggcaggagaatcacttgaacccgggaggtggaggttgcagtgagccaagattgcgccattgcactccagcctgggggacaagagcgagacttcgtctcaaaaaaaaaaaaaaaaaaaaaaaaaaagtcaaaaaataccagatgctggtgaggttgtgaagaaaggggaatgcttataccctgttggtgggaatgtaaattagttcagccactgtggaaagcagtttggaaatacctctaagaactcaaaactgaactaccgttcaacccagcaatgccattactgggtatatacccaaaggaatataaatcattctaccataaagacacatgcagctgtatgttcattgctgcactattcccaataccaaagacatggaatcaacctaaatgcccatcaatggtagatcagatatagaaaatgtggtacatatacaccagggaatactgtgcagccagaaaaaagaatgagattatgttctttgcagcaacatggatggagctggaggccattatcctaggtgaaataacataggaacagaaaaccaaataccatatattctcacttataagtggagctaaacactgagtacatatgaacacaaagaagggaacaacagaaaccaggatctactctagggtggagggtgggaggatggtgaagactgagaaactacctatcaggtaccatgcttattatctgggtgacaaaataatctgttcaccaaactcccatgacatgcaatttacccatgtaacaaacctgcacatgtgcccctagagcttaaaataaaagtgaaaaaaaaaaaaagaagaaagaaagaggaaggaatgagtgcttagagagacaaggagacaattagtataatatatcaccctggcaagtcaaaaggtgagacatttttcagtaggctgtagtgagcagtaataacaaaatatgagtagatttctagggcaatgaggacttgataaaaatatttgcatttggtagttatggtgatttcatagagaagtgtttcagttgggaggcagatgtagaaacttgactttaaaatgtaaaggaaagatggatgtttaggaagtagaaatatttccactaatttctattagatgagtgatttgaagcttgcttttggtgatcttgggtctttccctgtaatgctgagtcaatgtagagtaatgggtaggacagtagagttggtagaagatcagaaagtcaaacttaggttcaaatgctgacttttctatatattcgggttgagcatcccaaatctgaaaatccaaaatccaaaaaactctaaaagctgaaaatttttgagcgccgacatgattctcaaagtaaatgctcattggagtatttccaattttgaattttggggtttgggatgcttaacccataattataaagcaagtaatccaaaatctgaaaaaatctgaaatccaaaaaaagaatcagaaaaaaattgatatccataacacttgtggtcccaagtgttttggataagggatactcaaccagtacttgtgtgttaccttagtagaagttacccagcctctcagtttttcctctgtactaaatatacgatggtattacatcatgcaagcaaagcacttagtacacaccttggcacatagtaactattttaaaaaggtagctattattattattaccccccttaataattgaaaaatacatgatgactttaatcccagaaaagtaaacatttattgtgacaagcttttagtttatataattgccctcctaactgggagtaataaaatttagtagttattttaacaagtagcaatagataaattacttaacctctccaattttattcttctcaaatgaaaatggaaataataggagtaccaacatcacaggttttcactaaggatcaaattagaaaatgacagtaaagatactttgccaattatgaaacataaaatatttagttattattctttattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttaatttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttctaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatgtttatataagaaaaggaactaattatcttattgaaaagagtttttcatgatcttggatacattatgcaaagacttttactttttccatgacataattttttttttttttttttgagatggagtctcactgtgtcacccaggctggagtgcaatggcacgatctcagctcactgcatcctctgcctcctacgttcaagcgattctcctgcctctgcctcccgagtagttgggattacaggcgtgtgccaccacacctggctaatttttgtatttttagtagagacggggtttcgccatgttggtcaggctggtctcgaactcccgacctcaggtgatctgcccacctcagcctcccaaagtgctgggattatatgcatgagccaccacgcctggcccatgatatgaattttatgccaaagctttgctaattctttgcctttttcacaattagtttattaagagggtccctataactgtctttttgaataacatggacaatagtatcacttaataccaattctgtactacagtaagtaacattttggtgacatttagatatatttctgagtggaccatggagaaattcaaataacgacataaatttgtgtgtaatataatttatttctatggcttccatgttgatgtccttcaattttaaatctttaacccagatctttttccaaaccttagatttacattcacaactgcttcaagagaggtaaggttttcacctctgatttttcacttacagatacctcaaaatcaaacacgttcttgactttgctcctcacaactgtttgccatcttgaattctgcaactcatgattgagtgaagacactaccttcagtcaatcatgccaagtggtaagcaggcactgatttctcattttacctcacattttctgctcacctccacctcccacaaaacatatgacagtgttgattttatctccaaatagctcacgtatctgttttgtttgttcaacctcaccactttgatcatcaattcttgcttggcttattacagaaataatgtcctaactgttgtccctgcatgggtctcatatctttccaattcattctcctaaccactaccagaatgatcttttaaaaacatgtctgattagtccatttccttgcttagaactaggctatgacttaaagtgataaaagtccagagtctgaaaaataggtggcaaggggcagagagagccagcttacacttactgagcccttcgagtccaatagtctgcctctctggtatgcattttacatatatcttatcatttaaacctgataaaatcctgtgatgtactcattgtatagaagagtaaaattgggactcagaggtcagacaataagctagtaagtgctaaataaggggtcttcctgcttacaaggtccatactctagctgctacatcatgctgtctttccacataatttagccccagttgatctaatttcatttcttgtagcaaccataccccagccaagttccttcagattctcacactaccacactgactaagcctttggatatggtgtttcctctatcacgaatgctcttttcaaccccatgaacctaaataactcctaacaattcttctaaggtgactttctctaaacagaggttctcactggacaatagattcatgggtaggacatgctatgctcaattcagttggtatctattgtgggcagagatatttttaaaatctcccccagtgcataagcaaggttaaaatccaccgttctaggtgagtttcctggcctctttggaaggtttagcctagtcttctgtttttgctagaccctgtccagctctctactgtaattctcataatgctattataattttgtcttaggatgtatgtcttcacctctggaatgtgaacctctcaaaggcagaaataatgttaaaatacagaggcttttgaatatatgttacaaagtgatccagtatttccacaccgacagacacacacacacacacacacaaatacacacacacacaaaccaccgaaccaaagttttacgaacaatattgaaacttacttaaaagtgatggactccttatttctattctattttactaatttcattcatttctatcttaaaaatatggattgatactcattaaagtgattatacaacccagtacttttactgaactgtttttgaaaagcacctttcttggggcccttatgatggaattagttcccttataacaagaggaagtgtcatcagagctctgtctctctttgctatgttaggacacagagagaaggaagccatctgcaaaccaggaagaggggccctcaccaggccctgatcttggaatcccagcctccagaactgtgagaaataagattctgttgtataagccttctttcccttacccaccccccaaaaaagaaagaaaatcatctctctgaacatgtttgtatcaccagacctaacaccacgacacatggcaggtgtttagcaaagatacgctgaattaataaaagttctcagaaaaattttatatatatatatatatatatatatatatatacacacacacacacacacacacacacacatatatgtgtatataatttttaaatatccagagcagaaggcattcatcgccaggcaaaataaaaatatcaaaattcactttcacactctttagacaacaatcaaaatagaaagattaaaaaatacatataaaactcaattcaaactaaagcaacaggaaggaatacactaaaggtttcttctccttagaattagggatccttaaattgcctctgcattctcagatagtccaagaaatacgatactccaatttattcaaggtactaattgtgctactaagattgcattctttcttctttcttcagaattaatccgtgcgccaaaattttggtgagaaacttctccaattttattttattttattttaatttatttttttgagacagagtctgctctttcaccaggctggagtgcagtggcgccatctcggctcactgcaacctccacctcctgggttcaagcaattctcctgcctcagcctcctgagtagctgggactacaggcgtactccaccacacccggctaatttttgtatttttagtagagacgggggtttcaccttgtggccaggatggtctcgatctcttgacctcgtgatccgcccgcctctgcctcccaaagtgctgggattacaggcgtgagccaccacacccaattttaataacatattagaaatcaaagatatcttaattcataggtgtactcagatgtacaattcaaactttatgaaacttgtctctctggaaatgttttattcatcagaagacaatttttataatggggggattgagaggagacgtaggtaaaacacgagattagggaagggagtgatttgaaagatatggcctgagacatgacccagatcacagatgaaggtatctcatatatttattgctccttagtttgtcttgctgagaaaaatatgttaattacaccacctttatgaacatcataaaggtcaccacatacccacacccccacattgtctttacaagctaatattacaatgatctctcaggggtacttagagaaccacttaatatttgtgaaactcttgtgaaatattcagaaagacagagtctttccattttcagttagttacccagggttttatggtagtactttgaaccatgaacagctttgtcaactcttcttaggcccaaagcagaaaatgttttggatagagaaataatccgattcaattacgaatatagtttttttatttaaaggataaatctgcaatttaaaaatcctgaaactttcacccctaaaggctttgtatggcgttctataaaaatacatttgcttaaaaattccagttagcatatcagaaataacaatatttataagaaacacccccttatcctgaagtacaaggacgacggtaaagttcttgattttagtaaggaaagtgagttacacctttttataatacgggaggaaattctaatgtctttcagagaagaattaatcatgttaattccattcagaatgtatatgctttatattacatgtatgtttaaagaatctatgaattatgattattgctgagagaataaatatcttacgaagtggctgatagacgaaagtgataggtagtctagcaagagctggagtctccatatatagaaaaacggattgacagtcttagagaaaaacacattttgtgaaggttttcaccctctctcttcattcactagcatttgtatgaagtaaatcatcactacttttggggtagacagatatatcaaaatctgttggcagagctgttgctttggctaggcatttcaaatttcctttttttttaatatatgagaactatgattgctatacagcatgaatctatgaatacaatgctaccagcttcttcaaatgaagtgaaaaagcatgccatttcacttttctcctacctacatattatagaaaattccttttgttcaaaataaaaattcatagaggaaaaaaagcaaacacttccatttagctgaaatactgaaattgcatgtaatctcttaaggtatgctgctttatttattttcaagctcggcatttccatttgttgctcttcaacaccagtttcttgactcaattcaatcagctgaaatgtgccattaacaataatcaatagtttcagtagttcaccgttttaccatgacatctccgagtctttcatcaaaagatcattatccaaccatctaactaaaaatcaggagttggctataaatgtcatttcaatccataaaatgtagtttaaaccttgggcaagtggatttatagaaaatacaatattagctgccagggaagagggaaactgtctctgttttaaaataattttggaatcttagttaaccttattatagttaagacgcaaatgttgaggttttcagaggctctatgggagttttatctggattttgagaataaatgtagtttatcactttggggttgagacagtaaaaagcccctgccttattcccaagctctctctttttctacctcgggtacactgaaagttatgtgtaatatgtgccttagctcaaagatggaaaagagtagcctgatcgacactggactttatgtgagcaacaaataaactgtggtttggttaagccactggacaaaaacgaataaatacattttcttgagtaacatgggataagctaagacattttctcagcataatttccaactgcttttgaaagagagatcagaaatctaaacataaaatatttattttccatgcttccatagtaaatatagttaggacacatggtgaatcttccctttaatgattcagaagcttgcagtttcttgagattagaaatagagataaattttcattatataatacagcagatataaatacaaattgtatagtagaaaatagacgtatttttgccctcaactagatttaaagatatgttttattaaatccctgacataaaataattttttagtcattgggttattctttatttttcaaagtaatctgctaaaaatagactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaacaaattacctccaaatgatcaaactaactcaacacgcattttggaggagaaagtggggtcaaagcaggatgatgaagcaagaacgataaattcaggagccatacattgccactgttacgtactctatgcaacagagcagcaaagtagatcaactatcatatcaaaaaagaaaaacaggagaaggagaacgataggagggagaggagaagaacttctgcttattatgatttgattctggaattattcaaactagaatatacttttcataatagtttaaaaatatcataatagtttcataatagtttttcataatagtttaaaaatatcaaaaaataaagttagtctaaaaaatcaatcatcttattataatgatttatatccaaattgtatttgagagactagtaaagttattatatcaagtcagaaaaaccaactatacataacaaaactccataatagttcaggaaaattatatcaggtattgagaataaactttaagagcctccttgtactacagaatatgattctcaccaagacttcatttaaacaaaactaccccacgttctgttttcactgtttatgcatatggaactttatggaaataatttttgtttctaggaaaaacaattgtctgaaaattgtttgatcattaactacgacaaattcagccatctcattcttattttcacagatcatgttaggaagaaagctacaaaatgccagattaacatttcaaaacatatttgaaagtaatgaagggaaactgattcagttagcaacgctaaataaaacagacaattcatacagatgctttccctgtaaaatattaaataaacactcaaaaatgtcaacttttaaaatttaataaaccaatccctaagttatttctctgagcaaagtttctccttgaccgaagctctggttttatatgcaaatgttttcctggtcagagcatgtactttttctaagacgagggtgttaagtggaattataaatgatgtttccttctccctctgcctctctcctccttgtccaaataccgaaatacatcaggctgtataaaagcaactattttgttttgtccctggcttgtcagttacaagtacaaatgctgagaattgttcaattggatccacaagagtgctaaagcggaaatgcctgacttacttgccattgtttcatcagctcttttactcccttggagtcttctaggagcctttccttacgggtagcatcctgtaggacattggcagttgtttcagcttctgtaagccaggcaagaaacttttccaggtccagggggaactgttgcagtaatctatgagtttcttccaaagcagcctctcgctcactcaccctgcaaaggaccaaatgttcagatgcaattattaaatatcagaatggtgcacctagtgaactccataaaaagagaaagatggaggaactaaattgtaatataccaacaatggggtgagttgttgctacagctcttcctttaagcaacaactataatattgtgcagtctatttactttcatttttatttaacttaaaggcgtttgtatgggggaaggcatgcaagaatgacaattacagatttctataaacccctctccacagaggaggtttcatatatatatgtgaaatatatatacatatatttgaacatgtgaaagttcaaagtacctttttttcaattttgtagtttttgttggtcaattttgaaagcttatttttaatatactgccaaatttgagacaaacctttatagttaaaaccctaaaatccctgtaccatgcttgtctttgatgctgctctgaggcagaaaacaaggatttgatatgcaaggagaaaagtcaagaaaatacaaacctagaatcaaaaggaaaagactagaggaaaagacaaaaagaaggggattggagggcaaaggaagaaagacttaacaagtaaagaaataacatttcatagaaactatcattttgtgcaaactatcattttgcatgacatcagttataattattgtgttagtttcatatttaactacttgatcatacaactgagaacattttccaaaataaaaatgttatgtgtaatgaaaaagagtagagttttaaaaactaggcagatctgagttcaattcccagtgttctttaccacttacgtgatatggcaagttccctctctgattctcagtttctcatctgcaatatctattgctgtgatgagaattaaaataaaaaattcctgtgaagttgagtgccccacgttatacagttatacattacagttactcaaaaacattagttccttctacccatatcccatttccccattcctgtaatattttaaaaagatgaaacaaactctttcatgacaaaaactctaaaaatgtattcatatttttgatcatatatatatatatatatatatatataaaatgcatgtattgtggatacacacacatatgccctcagcaaatatctatataataatagcttagaaaggaaaattgccttaggcagtaacagtcctatggaaaaagattcaggtaaactttgtctgcaatgaggaaattagtactctatttaaatgtcttatttgccttctattactacacaaacactttctgggattaaacataagctaaaaatggattttaaaaaattgaacacttgaatatgatacacattgcttgttaagatgtgattgtcaataattatgcaaaactgcaatttatttcagcagcaactttatcatgggatgtgcaaaccaggcaataaacaactcctgccgagccagcggcagcaaagcccccggaagagctgtttattcatcatgggtgaggtttttgctgagcacacagtcttccacagtggagtttcagtgctcatactggataaaaatcttctgtctgcattaactggtggagggtagaataggtttatgaggatgtagctactggaaaaaaggaagcattgcactaagctatttatcaactcctaaataaactttaatactgcacagctgaaaggtagtgtagggttctggttgggcaaataaattaaacctcatgtagttcaagggctaacgtggactgccggctccctgcttatctagttttcaggcaaactatcaatgcaaggagaaatatcaaaagagtcatttatctttttatgtatcatgcttgaaaaattcagaaccactgcaacaactccacgaatctcaatgctacaattgggcatacaccttacagtttgaaccatgtgtaactgctgacaattgactgggtgtgacctataaaagtggcagtttcatgcagtttgcattaagacttactccatctccagtgcaaaatttggaacagaaataagctgtcacattccagaatataaatgcagggttagacatttgacatattttctaatgtagtccaatttcaaacaaaatttaaaaatatgaaattctcccatggcagagtgaaacttagagaatgtaatattgtgcattttatcagcatcagcttcatgatgagctgcgcttgatgcatcttagctcctctatccttaaactagaaatgccgcttaccctctgcttccagagaaagtaactagtaaataactttccaagagttatttgcaaaatgcaatgcacataaatcagatgaaagagttctaccgagacaatgtgattttcagccaaatcctaccagcaagtttgctgctttgtaaattaggcccttagggaagaacagtaactctttcaggacagtaagaaaccattttcctaaatgatacccttgtggtctgaaatattgacaacatcaggctgaatattttctaatttggaaaatacgttaaaaattcgatggcaataacagcagaaaatctcctcaaatgagctcctttacgtgcctcttgaataataggtaagactgttgtttcctgcttgtgtgggggttttacggcttcaacatttctctcggaatctatgtgtgtgtacgttgaatccctaaattttaattgtgccaggtctagtctagaatgagtcaagaatacttaatttccatatctgtgcattcaacatgctctaaatgtatcatatagttttaaattttccggaaccatatgggtttaagtggcttatatgataagtaaaatgtaaaaataagaatcataaagaaaaaaaagatatgttcagaaaaaaaaccaaaggtcttgaattagatttttttttaaattcctttgtccaagttatcaaactacaggccctggagaaaatttggctgaattttacaagtaacaatgaccagatattagaaactgtaataatgctttgcaaacagaatctactgtattggttaagtacttttttacataacaaagttttataatcagctattccagctttatggtgcacaaaaatagctgagaatttgatggagtaaggaataatgtgatttcaaaaggttttcattctattcataagagcactgtgtaccattctcagtatgtaaataagggcagcatgaaacagtgttctcatagtccatggaccagcagcaccagcaacgtctgagaagttattagaaatgcaaattcccaggcctcagcctagctctactgaatcagagactctgtgggtaaaatccggcaagctgtgttttaacaagccttccaatatatgctaaagcttgagaatcacagttgccaggaaccagatttgagaacgactggcatagtagatgctaagctgggctgcccggaccccttttcaggactgaaatacttctgaccccagctgctggtagtgctactggctgacagtcctcagctgttattcctgtctgagagctggactcagctaaagagaggtgcctagcccaaagttacccactatgtccccgagacgggctgcacgtattggttgatgggagagttgtggggtataaaatcctgggtcccttgctgcaactcaggacaattctgaagggctattctaccttcagacttcagagatcctcctggggaaggctaggaaggagaggcggagggttgattgtgttgtagttgtgactgtatggtagcccagcttctccttctgcccaatcctgctccctttcctttcctccgctcacaggtgttaatcctgagagcactctccaataaaattccttcatgctaatcactttctcagaatctgctttctgggagaacttgacctcctgaattgtcatgctgaacaaggattttaaaaatatacttgcctaagaaatatatgtggtctccaaagggaacaagatggaggattctcacatgcagtaattgtgcctgaattgctactgaacttttggttgccctttaaggagacctatagataatacaggtttgcattatcatcagttacaagcaagaatctactgaaggggcggagtgttggagctataaagcttagtgcaaccctatacgtgccaaagaaagtgtttatccagagacaactgcacatgaaggtaaagaatcacagaaggcatgttttcagcatacccattttctttttaagacctgattatcaatgaagaaatcaaataagtaagttctgacctgtcattagaaccctactcccgccacacacacacaccatggtatttctgaataaatctctaagactgcattgagttgaatatcatcaatttcttatggccaacataatacataaaaaggaaaaaggaagggaaacttgttgctttccggggtaagcctaaagagcttaattattgtatacacaccattctactattagatatatggatgaaaaatactttatcggtgcattatactgtggaattgtaagtgtgtaggtataattacagaaacatattgagtatttttagaaaaaggctcaatctgatatgaaaggttattttgcccaggttatttttaaaatgtgataaattaggaacattcaaagaactcagtcttctgctaaataacactttcactatggcctggcattgttatagagtaatcacataaaatactctgaatctttccttcctagtttatttgcaatttagccactatcatttcctatgatattttaggagaaagattaaaggatcattattttgttcctttttttggtgagatataggtcagagagaccttagtagcacctggatgtaagatcaaaatgattcttgccatatcaaccgctactcatagaaccagagttaatctgaaattcaaatttcctgtaaccataacagttcctactagtttgctagtaaattgcattttgattttaaaacataactttatattgtacttgtgaggggaagctagaattttgtcacctatggatatacagcactttgtagaaaggattccttttaatctctagcaattctattagtaacgtgcactaatgagaagcaaaagctgtcaacattgcctggattagtagtccattcctagcaaaaccaactctgtggttttatctgtttttgggcaacatctacctagaaatatgactggagaagggtggtggcaatgagagaatgtttctcttttctcctctgttatgaaactgtaaggcgaggaatatatgacatcattttaatttaacttctgatgcttgcttttcatccacagcatgaagaatggcagatctaatgtacagcatggaagataatttttaaagctaacatccacataactctttatatgttttcaaacatattcagagttattctatcatcacttcataagatattttccatttttctacctaccttctttttctatgtatactcagctggatatttcattctctgccaatggctttacactcgatacagattatctttaattctgaacctcattcttatttccacatgcctaccaacatctaattcaataattcatccatgcatccattccgtacctattgtgtaccaggatctgtgcctgatgatggtgacagaaaatccaataatacatggactttggtatttaacatattcaagtttaacagagggtacagataggtaaacatttaactagagttacaatgtaattaaggctataaaccatctggagtccttcccagtagctcaaatgtaacatatatcaatctgctttcataaacttctatctcaatttgccaaacaagtgataaatgtatcttaaacatgttttactctttccatcaaaagaggtggagatcatccagcaaggctttatctcaaaatagagtgatggatgcttaacaaaagtttgcctaactaattttcataaaaataaaaaaccttttagatatacagtacaggcttttgctggtttcattttagggctggagagattgattctgagagaattgtaatgatgttcccaaggttgtatacaagttaagtggcagagctgggggtatagcccaagtcttgcattctagaaaagaagtttttgtaactctgaagacagatattggaatacactcctctctgatatattcattgtactaaaagaaagaaaggcacaaggaagattatgtcactgaatcctggtcttcattttagagcacaaatttaattttctgttattgccatatgcagggtcgttgaaacatacaaatacctacacataagggaacacatacatacaaagatattctcctacccaaactattgcagaaaagatctggctgctctttgctttaaaataaaaatccatttttaatgcaaatttgctggtttgccgttcaccaacatatgaattaacgaggttttcatcccctctctcttgaggtctggtactaaattactcaaactctccagagttaattggaaaccatgacctaaatgttcccaaagtattgctgattagttctcagaaaactcattcccatcttttgtcaccccagacaccacaggatgactttttaacatgtgcagtagcaacacactggcatgagaaatagattaatcctccaaagataaaccacagctttgaagctatctgtgtaaacttccttcactgatacagacattttattttttaaaaaaaatatacatatcacctagactttagatagtaagagagtataggcattatcaatcacgtaaggaattttgaaagacacatttcatctctcatttttttaaccttatgaatgtttttaaaatagagatttgcgaatttatcattagggaaacaaccataattatacactttccctaaaaccattagtactttcctgaaaagacctgcattaggagacagcagtagaaaatgtgttttctactttactttgcattacccgtttcatttgatttgtatttcaactcataaatcactgaaaaaaattagttgataaagaaatgtacacagtgttatgagcagatgaaatacacgtctctatacacacatatttttttctttcttgaatttttaaagagattgatactctttaagatctgcattttatatttttctgctgatacaatacgaaaaggtactatttggagaggttgaaatataatgttgggagtaatgaattacatttggtttggttaatatacagagactcaaaatatccttttgggcatttatacaactgtaagggatctttagaaaaaaatgcagttaacactacttcccagataattacacacttaaaattggtgttgacctatagttggacacatttctgttctaaataaattctcaatgatttgtataatgcgaatttttaagttggctttggttacttgcagtgataaactctttaaagatatatttcctaatgttgatagactaagcagcttttcttctctcctaaaaggatttgtttaaaatagtataaaaaccaatttaaaagatgagcctaagatcatctcttacaaacctgataagactgtgcagttatatatatcctcatccacaataacttagagaaaaacagaacaaaacaactaactgtagcttgttagttgttgatacataatattcagaagacagcaaagcaggcaggttcagttttctaatatcaaatggcaaacacacaacagattcactttaaaagaaagaagtggctaaaaacatatcaacagatgaaataaacttatagtagagtcctgtcagtggaatttggaaatacgaacaatttcataaccgctgatctaaattctgaattatgatatcgaaatatttgtgacttttattacctagtctcttactcagtactctcttgtggttaataatacacatttgaaagggcccttttagcaaagcacatgaacagacactttttaaaagaaaacatacatgcgaccaacaagcatatgaaaaaaagctcaacatcactgatcattggagaaatgcaaatcaaaaccacaaggagataccatcacataccagtcagaatggctatcactaaatagtcaaaaataacaggttctggagaaaaagcattgcttataaactgttggttatagtgtatgttatttcagtcattgtgaaaaccagtgtggagattcttcagagatcatggatggagctgcaggccattgtccttagcaaactaatgcaggaacagaaaaccaaatactgcatgttctcacttattagtgggagctaaatgatgagaacacatggacacagagaggaacaacagacgtggaagcctactggagtggggagggtgggaggagggagaggatcaagaaaaatatctaatgtgtactacgcttaatacctgggtaacaaaataatcggtacaacaaacccccatgacatgagtttacctatataacaaacctgcacacgtgctcctgaacttaaaataaaagttaagaaaaagccattttatattcaacatgtattgttatagtattttacactaaaataatgttctgcagttttcaagctcctttgacaggatccacagatagcacctcctttcatattttaaatagcttgatgaggctaatgaggcaggttgtaattatcatgaacagtttatagatgaggaacttaactttcagggaagctgggtgagttgccaaaataaatgacaaatcttgaaacaatctagtccactgtactataagacattacctctcaaggtagacttgccagtctccctgtgaagtaaatataatggatattaatatgtcactattctcaaaagccctttgttttctgttattattatatgaattaggattatggggtatgtgtgtatatatgtgtgaaaagagaaaagaaattattattcctttgcttaccatcttcatccgtcatctatgagatgtgttacaataaatactgaactttgaactcgaggtaagcttgaggatttgatttagaaagaaggcattacaggcattaatcgaatattttaattcttatgaaattatacaaagttatagtacatacaattttggccttctctaaatgataagttagtaaatgttggttaatgatacagagagtatctgaatgtctatgtattttgggatatcttttacataaaatttctaacatgaaaataaaatacttcatacattgctttactagacattttacagtgaaataaatacattttaataaaaccaactgaacgatgaattaatttgtcgaagtgacttagtttaagtagattctaaaagaattgcccttctaattgtaaacctattttaatggctcagatatgatttacaagacaagatgtgggattacaagtagcttgagctaattaaaacttatcaaaataaagatttaaagtttcttgctttcgtacttttaattaccagggtgaaaaattgcatttaaaagacctagatactttgaaatgtattgatggccttttataagatcaattaaaatttataaagaacagtcataatttaggatttatttttttcaattagaagtacaacatgaaaggaatgaatctgagggtgcatctggttttaagaatcctctgacttatgaatataccacttactatagtctggatattcatcatcgtcatcaccattcatcaaccacaacttactgtaaattatttgagggcaaagattcacaccacagttcctggcaatttaatagatactcaataaatttaattaaagtcaataaacctactaccgataaggtatacagcttctaaaaacaaggccataggctcttgttcttaaaaaacttaaaattttcttgatgtgaatttattgaataataatttatatttatatagaattttagagtttagacattgctttcacataaattatttcagttgaacctcataataatttgaaaatattatctttgttataaaaaactattgttcagttataaccaagatgtttaaaaatgagaatgagcaattctgtgcccaaaattgtgttttgctttgcaaatgtacagatattcaatctttggaatttgtatctttcatcaaattttatattagccatgaaagtgaaggggtggactattttactgggcaacacattgtatttagctgtcaatgactgagtttctgttactcttccacgaaagttaacaattttttttctgaattttcaaaatgagtgtctgcaaaaaatgttatttcaatactttctaggtgtattaaagaaatagacagcatacaaataataacttctgtcaaaattaacctgttattttggcaaatgttcagattgcctataagtttgatcctggtcttcagacatcaagtaccaaaagtgccttaaaacgcatcctgtccagacacccatttggcttctgtcacccaaaatactcctgccctccctgctttttatcacccataagtttgatgggcctcctctctgtagttctactcatgttctgtcaaaaacatccagtgtgtcagggttgagaacagaagcttgtgacatagcaccagagatcttccatcaccacctgacactggtctattaatcgacatcctttgcgtaaaatcatgaagtggcttctaagccatccaatttatcttgcatctagccagtatttctccaacttattcacaagagtataacgaaagactttgtcaaatgcccagatgaaatgcaaatagactgctgcattttacttacctacttgtctaaaagtttttcattgtaaaacattattttatctcaataatttagacaatagggatttatccctgtatgcaggtatatctgtgttgttttactaaattagctaatctcttcaataaatgggttcatatttctcttatagcctccacgtaagttgcatttagcattttaaatgtcttggacagctacaataatatctcttataatttttacataaaattcaactgcatttatcaacaactggttagggggcgattgatatagctatgtgaggggaaggagaatagatgagtgttatcaccacccttttatagagatcatgccattcaagtggtgaaaatagattataattgcagtgataatcacagaattgtaaaagactgggctagacaatctggcaggtctgaaatggtaatttcatttagtcttgtaaaaatggcaactgtatcactcagaaataggttaggtgctccgaaaatactgctatttcattaattcacaaatcagtatttgtctggaaagatatttaaccaaattatacagaccacaaaaaaaagaggcatcctagaaattgagggaggacatttgactatcacagtgattgaagagtgttactataatagcattctgtggagagggaatgaagatggtagacttcttatacaacaaagaactctcccaagtctgacagcactttggaatatcccactggacatgcatgtatgtggaaaccctgtttataaacacctaaacctggaacgtaactcaattttacacgtaaacataagatattttcctcatgattttaagacattgaatttttcagccatgcaactaactgccataacgatccaagaaaaaatttatttcatggtgttaggaattttgccaagagttgttcagcattttggaaaattacgctatggatgaccaatgcccctcatggtatttgagtctccatacaacacaatggtgtcattctgcatttgtttatactgcattgatagtctcgtgatctaaaaacttcacttgtgttccagtgtgatcctgcctgaataactgcatactacaacacatattattttattataaatgactcttatttctctttaaaatagagttacggcatcatttaaactattgcctgtataagtagggtatgttgtctacatattttggcttataatcgtaaagaaggtattacaaagtatttgttatttaaaaaagaaaagaggggtggcattgggtctgagaagtttgaaaaccaccgatacagagccactggggaatctcaagagaaagtttattatactgaaaattaatagaatttttcaggagagaatgaggatgtgtcccctccctgtgcatccaatctctgatccctagagctccatagagaatgaaatagcattttaaaaattgctctcttctacaaccagctgtgactatcggtgaaccggaggtctacttcatatacgaacctgaattaaaaacagccagcccttgagtcagttcagagcccacgttcttgattacatttgacacaataatcatcatcatatcttaagactcaaatcagcctgacagtgctcaactcagggctgcttctcccaattagctgaaaattgcagcccagctcatctcctagggaatacgtttacatttacaattttgctgtggcaaaaaggcaacaaacacgctggaaggagcaaatcagctttttaacttttacactaactattttaagtttacctaagtctggtaaacctgttttgacaagaatgacaacgaggaagctttttttgttatgattttttataactgcgcaaagtttaagataactagagtttggactagaaggggaaaacagatacacaatgtgaatatttttacaagttacttgtcaaatgaaagctttcagaagaaacagcctttctttggtaaacggtgcattaaaataatttgcaactaatagatagggacatgtaatttgaaaacaaaaagtgagtaaatgtcaaggtcctaggaaatattttccaattatatgctaacccgataactccatgtccatgtgacatagcgttattctgtgtaattctgtaaattacttctctcctatatttctgaggggtggaataaccaaggacatttttgtgcattttgtttcctcaattatgatacctttctatgcagatcagggcagtttgcacacactatgggaaaaatggaaagtgacaaggtaaccatgcttcatggtggctgtgctgaagatttgctcagataacagtgtccttatgcgctgtcttctaagcggatgacagtgcagacatggaagagaaatatgcagatgggaaaacatgaatctagaaaagtgggaaaaatactgaggagcaggagacctggaaaagtaagacaattctagagtgggctgagatagaagacatgttgtaaccactggggacaggaaaacatgtgaacaggaacatgtatataagctgacagtgtgcaagagctcacagaaagcaaatgctaacagtaatagagaaataccattgaggcagaggtagagataaaaagaaataaggagggatcggccatggtggctcacgcctgtaatcccagcactttgggaggccaaggtgggtggatcacgaggtcaggagttcaagaccagcctggccaagatggtgaaaccctgtctctactaaaaatacaaaaaaaattagcagggcgtggtggtgggtgcctgtaatcccagccactcgggaggctgagacagagaattgcttgaacccaggagggagaggttgcagtgagccaagatcgcaccactgcactacagcctgggcaagagagcgagactccgtctcaaaaaaaaaaaaaaaaaaaaaggaataaggagagaggcaaagttgaggacaggcgcactggggaaatgacagaaataacaactcagagaaaagtgagtaagtgcaacatctctttgagtcttgttattcccaaacatccctattcacccaaagattaacatttcctacaagacaccatgttatgaatatccttaactaatggatatccctcaagaagaaatatttatttttcttatagtacagttacatacatttgggaattagaatggatttttaattggtttctgatccaagttttaatcattttgcaggaaagaagccaggactcttacaacatatgaatactcatctattatgtataatatcatttaagtggattttgccccaaatctttgtggatgtgcataattgaagaaaaagataatgttattacttctcggtaaattaattgacggtttctcctttaagattggtcaacaatctgagtactatgagcaacacttcttctatagattctgttctcctttagaaaacaaaattcacgtcttctgttgtagaattaaatctttgacagttcttaatgttgagaaaaataaaaatatcctcacgaaagtcaacattctttaatattattgagaaaagagtatacattcacattttattaaaactacggtccactgctataagtgtcatgaagttaacatatacctagtaaagtttgtaaaaaataatcagaaataagctttagtgaaaaaatccacatgttgaattttgctgtttctcacattaccttaaagtgtttttccaaattctagcttagccaaatcataaggaaactgaaatagaaatcctttgagtgactactacatactttaaattatggatatcatgttgtaaaacatctggctcattcttgtgctgtcatgattttccaaaataaaacatttgctgtttagatgttgtcatttaaaaagacccttaatgattagtcaactgatttgctttagttgatttcaaagtatatgctaattgacaacattgatgatgacacaatacttaaaaatcccatacaagttgtccactgaacaatttggtcatttccttattcatttccttattaatgctcacagaagcatagttatcattttttttttagtgagtcacagaatgggaattaatttattttaatccaatgttccgttttccttattttgctctatcagttttgtgagcccaaagaaataaagttgaccacagcaaaagcagtgctggggaagaggccagtttataggataactgcaataccttttacttggaaatatgtttgaagatcacctgaaagtttaattgacacaggatgggacagcacatctaggaaaaatggatgccattcagacaatcgttcttccgattttgatctgactatctgttcgctttgcggtgtatatcaaattgttgaattaaatttcaaaaacatcacaggtctacagggaatcattagttcccccaagtactttcgagagttgactgtagctcttttacttccctgctgtaatgacaggaaacgtggtctgaatttattgctatctcccacctctcttagagaccattgttcatttcactcatccattttccttcctgaataaatgtcaataggaaaaattggttttgataaactatattttatagtttgataaactatatatgctttctttttcaccttcttattgacaacatttgtccgattatattagcaggttccaggactaagtttaacaattattgttaagagtttttgtagggaaaaatggtatttcttgtagatatattagtagttgataatttatgtaaaaatttagtgtttgtgataggcacttttttaaaacttttcatttgaaaatatgaacatcatccatttccccatctaatcatgtctttcctgaagcatatatttttaaagtagctcttaaaacttgcaacatgtgatgtagctataattattttaatctgcatgaaaaataataggataaaaattaaagtatcagtgtaattttgatgttagaactaataacattgcacatttgttttgttagtgaaatatgtgctcaaatgatataagaataatattaggtaaatatggaaaagtagttctatgaagaatacattttttaaaaatcttagttcatcaatgcagtgaaagcaaatacagaattctctagattctcccattaaattataacagtattcagaattctttcaatatatggtggaagaagcaaaagctgatattaatagaatattatgccttttctcagaaaaacattatactttcatagaatgtggactcatatatatgtatatggagaattttgttcaatgtgctcaatatctattgcagtatctggcaaagagtgagtgcttaatttttactgaagcacttaattagaaaatggcaaatatatgtcagtatcagtattttcaccatagatactttcattatatagtaatcacagtagtgcatatataactgccactgtctgattctgacttgtactttcaaagttagaataataaagctctgccaggtaacccattttcaaaagcaaactttggcaaaactttggaatacaaaaaagaagatggagagaaacttgcctttccaggaagaatggcaaagatgtggtgagatgccctcttagagccagtatgttaatacgctaataaaagtagaaaagacttactagaactatttgaaatatcaaaaagtaacacatcactgtatgtgagaaaattctcaaaaagttacagaacctaacatcatataggtgatgctgcaatgtaaaaacacacacacacacagaaaaaggagactgatagcaaatacaagaatttctgtgtcagaattaacacaaactggtgttttgagcttaggaaagtcacagactctctgtgcctcagtatccttttctctgtcataaatattttgatattgaaattggtgacttcataggttaactcagacctatagaatgtcacgttcatttagaatatgggacagcaaattgtaaagatgtctgtccacctgctactcatttggcaaacagtgcatatcccagggagcagaacccagcgcaagcaagctgtcctaccattatcaattaagggcttgaagtcaagaatgagtcccaagccactggtttgccaaggagtctgcaaaatcttgctagaactttgactttcaattctggttcttgcaactgcactattaaagaaccttggcctcttcttagagtagaccaggtccgtccaccaggaatagttgctaagagttatgggttggccagggttactctacatgagaagtgtatgggggtttactcacacacaccaagtgcttggctgggcttctggaattgcctacctgtcaggataagttttactgttaccagcagcaacctagcaactaggctaaaagtaatcactagcgtggtgtggtttataggttttgtgtgggaaaaaaatcctcaaaattatgagttacttccattctattagaatgttgatgaagacagagtgtcaaggagggttaatggcatttgtttcagggaaaagaaaaacgttattagcagatcccagcaattttaatagactctattgtctattgcctctattgttgattgccatctgctaaaatagagactttattaagtatagcttcttttactgaagatatccctgattacttcggtggatttctaaaaaatttctcctccatcctccttgtgggaagtctcaggaaaaaaaaagattcaatatgattcaaataggctctgccagagaatcaatctctatcctctctctgtctctagctagctagctaattaatcaatattcccagaaaaaagtccttaaacttctaccagaatatgaggtaagaataacagccttggaggagtcatagaaaaaaatgtctgaatagagtcaaaattcacgtaacacaaattcccttggttagcatggcaaatgtataggcttatgcctacgtgaagaattgagctaatggcactagagaatactattcaggtaactcacggtgagatgatttcccttcagtggcctggcctatatgctatgctatctatcttacaaacacttactgagtgcatgttctatgcatagtattggaccagatactgtagtgttgtataagattcttgagaaattgttttcatggtcaaacttttagaagggatgcatactgtatagattatcccttccccccatactttcataaatacacatactttgttgattcaccaagcatgcactgtaataagggtctgattactcctatgggaaagaagtctgttcgctttgatttaacttgatattacctaatcattttttcatccatagaaccctttcttgagttattacttattaagatacagtggaactagttctgccaaaaccccatttggaaaaagaaaactcccactctagatgatgagtatgtgaagatcaggatgttataccatacaaccaccaaggtatcaccaacctgttcctgaatacttctacaactttacaaggcagcctgttccatctttggacagctttataacaatattcctctctctattaagctgaaatatacgttcttaggactaggttatatgcttaaatttattcggcctaagatcccctttggctttcctttcccactgttctatcacattgtgtgttgtgtgttgtgtgtgtgtgtgtgtgtgtgtgtgtgtaaagagagaagtgaaacagaaggagattattgttgctaaaaactctatgttatctccatatttggaatgtttttggttggtgtaggcagtggttctcaaattttaatatgcatagaaataacttggaggcctgaaagcttgttaaaagttccccaagtcccatccccagagattctgatttagttggatggggtaggacctacaaatttaaatttctagtgagctcataggtgataccaatgctgccagtcagaggaccatactttgggtaacactgcggtcttgggtacactgttgctctgccaagacctcatgccctagctggttggaatattgactactaacagctcacagctgcctccctccctggaaattgccttcagctgtaggtaacaatcttactccagtctgctctttcccatggggtgacccaggaccattaactctctagtattgggttcaaaggtccagatcccttgcttcaattcagcgtgtctctaaagggccatgcaatttccagaactcccctgaaaatctgatgaggccgcaacgcactgcaggcttcactgcacttcttcgtctgtgcaatcttgcctatcttacaaccttacacatgtatctcatgggaacactcctcaacaaaccttatgcacacaactctctatcttagtctatttccagggagcccagtctaagttagatgggttttttgtttcatgtttcttttgaacccacatgtagcaccttgcatttacattacatctttcagtattcagcctaccagtccaacttgttgaaaactttttggctcctgatactcttgtctgctatatttgctatttctccctgctttgtggcattgatttgataagaatgttatctatgtcttcatccaagccactgatgaaaatattgaaaaggacagagctgagattagattaccgggaatagctgcctgaaacctccttccaaattgataggtatccattagacagcagtgaagggagcataggcctcagagttgcagatttgggatggaacaacagttccgtttaagcagaggtcaaaagctagactcacagctaaagagaacaatgccattttagcatttctattttaataggaaacttaagtatcacttatataacacatttcaacaaaacatatctcactataaaaacataaaatcataaataatcattatgaatttatgattattattcatctaatttgtcccagcatgaaaactgtatttggtcatttcatggagggttttttcgtttacacattttaaaaaagaggttgtgataaagttgaagttcaacagctaccccaacttcactaggacatttaaaatactggcaatataaaagaaaaaggcaatccatcagtaattgtatgagcggccataagtttaagcaacgtaggttattatctacaaaggtgattgaatttggttcacctgatttgctttaattgctctgtggcataaacacactgactggacacagagtgatgtaatgagtatcataattaggaatttgataaagctaagtgtgaaactgactattagaagatatttgaaacacacaactactgctttgaatggggaattgatttcctagttaatttaaataattttcatctctttctatgaatactgatgacagacggaatgaccacagcataaaacattggctggaagaatgtcactatgtacttcaagaaattatttcccccatgttttttattgaaaagataaacacctgtccatttccttcctaataaaaatgtggtaagatttttttaaatgaaaaaataaaactatctgaaaatgcttttaactgttaataaacagggagtaagtaaaataaaaataggcaaaaatatatttgcaaaaatatgatagaaggaattgctaagaatgttgagaatgattctttatttgtaaatttttgatagtttctacaataagaatcacttgtactaaaggaaagaagttatttcaaaatatagaagaaacatccaaacacagaaaaatggtagataaaataccaaaatagaaaatcaaaaaggcacaatctgggcttagaaacaagttaagtagctctgtgtttcagaaatgccacaaaaacacacagtggtgcacggggctgcagacatagggcttttggggcctgggctgggaagtaggtagcagtagccaggagttcagattctgctgggctcaagaatctataaacactcggtataagacaaaggacctgagccaggctctttgctgcaattagtcaaggatgatatcaggtttccctacggggtgaaagggagctgcaaaaaaaaaaaaaaaaaaaaaaaaaaaaaaaaaaaaaaaaaaaaaaatctgctattgatcacaacctagaactgattaaatgacatccctttttagggggaaattggaaagattagatttcataaaactcattaatacctatatgtccaaacatttttaatataagaaatcatttgaattaatgatttagagaaaggaaacagatccctgttacatactgaataaagccaaaggatcccaaaactataagatttctagaattgtgcagaaaaaaattaagtcaagtgatgattatattcatttattaaaaaaactcaactttctaaaaataaatctacctaaattctatttttattgaatgttttaaagaagtctttctgagaatgatacagatagaaataaaatgaaaatataaatataattgaaaagtaacatgatgggtattgtagctaacattaatggttcaattaaaccaaataagaaaaactttctcccatttgctttaatatttgatactgtaatattaaatttatgaacaaaaaacagtctgttggtatcctataattttttattaggaaacaatggtaagttttcgataatactattgtttttcctgggaaaactgatacataggagcatttctaagcatatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctactgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccattcagtgcccaacatctgatgaattgtttcattcaattacaaacaattattgagtacaattactcagcaaataaaaggtatggctataaaataatataacagtctgctgaggatcataaaacagtccttaagtagttccagaaaaggaactctaaaattatattgccaagggacggtatttgtagatacagcatataagactcttatgaagttctaatgcttgtccctctcctaaataaacaaacaaatgaacaagcaaaaatgtataacactatttgcttttcttcccaggaaaatgttttactttttcatttgtttttactttcagaaaaatttgagaatgcttttggaaacatgtcatacatgtaaatatcatgcatcaagtctcaggagggtaaaaaaaaagcactggaatcaaagggaagcaagaagattcatttcaaggaagacagatccaaggctgttgtgaatgtcaaatgagcgtaaagacttgataactggcagaatagagaaaagttggttacaatctcccagaaatctacaaaggatgaagaggctttaggatgaggtgacaatagggataaagagagggaattgtttctagagcaatttttgaagtagaattcacagaatttggaagccagtttaatacatgtgtcagtagattgggaaagagagatcaagagaaaggtagaaggtaattcttaggtttccagttttagagacaattaagttagacaattacactacactgaaaacacagaaaatttaactttcttttaggggcaagataatgcattctacttgacacattttgcagcctgtagcatatccaggtggtaatgtaggttaggtggcagaaagtacagttctggagatcaggagaagagtgtaagatggaagttgacactgaggagtcttaatgttaactgaagccaacagacaaagctactcaaaatgtgcagagagaaagaagagagacaattaagaatggaacatcaacatttaaaattgcattgaagacagagaacttgcactgatcattgttacaactcccaactttgtatcttgagctactccccataacttaagattcatatatccagctatctactccacacatctcctagatgtataataggcatttcaaatgtaacatatccacatcttcctcccaaaatatgttactcctggagccttccccatctcagtaaatgatgaccccatctttccgttgctcaggctaaaaattcttgagtcttcttgactctttctctcacacctaaatttattccattataaaatctgttgtgctctgtacccaaaatatagtagaatccaaccactcctcaccacattcacctctcccattctgatcccagccacagtcatctcttgactgaattatgacaacagtttcctaatggtctcactacttctgtttagtctattgtaacagaggagccagataagacaaaacatgtcactcctccattcaaaaccctccaataactcccatctcattcagattaaaagctaaagtccacaggcctaaaaggccaatataatcagatgccagttacccctctaaatttattgtcaactaccttcctgctcgcttgatccttttctgcctaactgatctcccttttaaggttccttcaacatgccaagaatattcctgctttggggcattttaacttattaggactctcctggactactttttcccccccaattatacatatggcccacatcctcaggtcttttagaatttgcttaaatgccaccttttcagtaagaccttttttgattaccacattttcatggcagcactcctcttccacctccctctctctctccacttgttttcctctttgttcttccacactgtgtgtatgaccatctgacacatcatgtatttaatttttatttgtcaatgtctgtcttccaacttctgcttccaagaatataagctttatgagggtagggcttttcattgctctataccaagtaccaattactgggcctacctagcacaaacttcatacaaaagtatttgttgagtaagtaaattaatttttatggtgtcgatggcagatgatattttactgagttcttactacgcactaggcattgtgccaagcacctcacaattattatatgattagagaaatgagatattcaagataatattgttctgggaaccaaggaggataaagttttgattagcagagttgaccaacaggatcaatgttaaaatatagtcaagaagatggacgaattaaaatacactaattagctattacaaagtcactgatgatcttagtaagtccttgttttcataaagtggtggtgctggggaagtgagactggagtgggtcaaagtacaactagtagctaaagaacaggaaacagtaatgccaactactgcttaaaaatgatatagtaagcagaagcaagtacagctggatagaaaaaaaatgatatactaaaaaagttctcttaggatgagggagacttgagtatgttggcctgctaaaggggaggagcaaaaagaaagaagaaattgaatatcccaaaaaaaggaaagtagaataattactaaaacaacatgttggagaatgtaaaagagatctagtgtttaactagagtagctccttgctacacacaaaatagggctcaattgttttctcttttcttgttgcaatgaagatgagaaaggacctaggaatagagaagcaaagagtgacttacaagtgccttcaaggttgtcaaagacggagaaaacaggtcaaaatgttttcagatgatcaactattaattttgatcattaaaatacaaaacagtattataaagaacagagaatactgagatgttatggaagaaaatgtgtttgtatgtatatgcatgcatatgcatatacacgtatatgtatatatgtacacacatacatgtacacacatgtacatgctgaatctttcttagaacctagagggattttttagtatctgggagcttagctaaggaacttctaggcatgtttaaccctctgatgcaaggaccatctcctctgcttgatgagtttgtacctggctagttggcagttgtggaagccctcatacagctacaagcagacaattcagagttaatgcttatttcttgtttaaagagtgatcctggaacagaaataaggaaatgaaatctcatgacagtgtcatcataaagtcatcagccagatggcagtccttgaaatctaatccttagaggcttctcacaataatttgtaatatcacatctaatattatcttattcacaaactcatatctattcacagagattgaagacaaagaaatgaacttgcagaggctcacatttctggctttatatgttatcatggactctgtaaggactacgataaggaaaacaacatattttcctacataggtcacaacaataatctatgttcagatctgggtttctaaactgtacaatttagttgagaagcagccttctcttttttccatagatagattagttccttttaagcataaatgcctatttatatttattctatataaaatggcaagtaaaaatgatcatatcaaaagccactgtagaatttgaagactcatctgatgtattaataaacttaaacagcaaaatataaacattagtttacttttttattatgtcttgaaactgcaacatggcagtgtctgatatcaaagcaaatttctttcaagtacattttatatcttatttaacattcaacagtttaaaactaaagattttattactaatttaaatattcttccaagtgtacaaaaattttgcctaggtttctccatgtgactgaaagtctcagtgcaggcaatgcattagtgtttcatagtaaaatggtgtctaacctgaactgtgagaaatgatgtaatcagaaaactttccacagaatccctcctacctaaaaagctatagttacagaactttttcaaagatatgagatactttttctccataacccaaatattgacattattaatctttcctttttaagatgagtttaatataacaacaaaagtgaaaatgccatcctgtcatagttgtagtttttgagaccaacacaaataccatggaatactacgtagccataaaaaaagaatgagatcatgtcctttgcagggacatagatggatctggaggccattgtccttatcaaactaatacaggaacaaaaaaccaaataccccatgttctcatttataagtgggagctaaatgatgagaacacatggacacgtagaggggaacaacacatgctagggactattagagtgtggagggtgggaggagcgagaggatcaggaaagtcaactaacgggtaccaggattaatacctaggtgatgaaataatctgtacaacagacccccatgacacaagtttacctatgtaacaaacctgcacatgtacccctgaacttaaaagtgaaaaaataaaaataaaaataaaaaagaaaatgtataaatagaaaaaatcaggcagaaacaagtaaatgcattacaacaagccactgtgtagagacaacactttttatttataaatagaggcaataagatttttgaagtagcacagtaaataattattataaatgtaccctaaactgcttaacccatttatgcctaaggttgcaattttttgaatttttgcaatcagaccttggtgaggaccttgaacagtagaatataaataattcccacatgcttagtattccaataatggaacactaggataaatagctaaagtgaacatagacaaagatgatctagagcaggactatcagtaaaactttctgtgattggtggttacctgatgctgggaagggtagggggtgaggggatgaacttgattcgattttgcaggctcagagatggaagggaatttgcctcacgatgaattgtgccttgagtctcacccatatctaatttatattagattgcacttttgagtttatgctgaaataagatttttggggctttggggatgaaatgaatgtattttgtctttgagaagaacaagaattttggggaaaagggggcagaatgctatggtttaatgtttttcccttcccaaacttatggtaaaatttaattgccattgcaacagtagtaaatgtgaccttgaagaggtgattaggacatgaaggctctgccttcatgaacggattagcatcattattgtgggagtgagtttcatataaggacaagtttggccccattttttctctcttttggtcttccaccttccatcatggaatcatgacacaacaagaaggcccttaccagattccagccccttgatcttggacttcgcagcctccagaactatgagccaacaaatccctgttcattataaattacccagtctgtggtattttgttacggaagcacgaaaaggactaagacaaggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttagttcaaaatctgttttggccccagtggtgacttttacttcttgttaaaaatcaccgagcttattttttcagtaattgatgtcatattttggaactcaattatttttcaccgtggtcttcctcatattgtacaggtgctattttttcagcttgcacaaggtaattgtacattctgcaaagggagtcatcattcaaaaaacatttactagctccctattatatcacgtggttcaggacctggggatgtatcaaatgagaaagacaaaatctctgccctcatggcatttagattaatttaaaggacaaatatttaacaattagttacataatttatatttttatttatgattggaataaatgctagtgaaaaaagcactagagatcaagagaggtataataaggatacaaggcttagtttgaggagatactgtctataagcgctgttaatttccattcatatataatgggaaatgaagtgacgagtcatattgccctccacaaattttcccattgggtgtgtggagtgagatactaggatgagaccatgtacagctataactctatcatgaatcccaaagtgacttatttatcagataacaggtaaggcagtgtgcgccatgatgagatagaaagatattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatgtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaacctaccatatgatttagtcaatcatgacagtataaggtaacccacctttcaggacaaacttttcaaatgcagcatcttgagcaataaccagtatcaagtatttcaacttagtagcaattaattggcaataaagtgggcttaattgtttttatcacaagagaaaaaaactacaaaaataagctcatatataattgttgaatatgtgacatataacaacatttgaacgaaaaaaacctcatacatttctttccctcttcattaacttgttgaattgtttatgtaattagtgccatctactggcgttcaactaaacctgcatacagaaaatattgaacaacaaaagaatagtactgttattctagtcacgaattttttgaaggatcaaaatacttttagaataccttactttaaaattagaaaaaaagtcaaaatataagaatcttactaaaccaaatcacctacattttcttcgttgtttgtctttggcaattcagtgttttcaaacttgctatctcatcacttgaaacatatttcaaagaaagaagtcaattaatggtaggttttatctcgaagcatatcaacctgaaatttctattaaacatttctgcaagtgcagagaggaggcttctaagcattaagataatactaattgttaagatagttatatcaaattcaataggatgggttaagtcattgataaatggacacaggaataggaacaggtagttcaaacaagagaaagagtgggatgattttatttaaaaagaaaaaagttaactttcaagtaataaaaaatagagtattaaattgaaaaggtacaattggacaccaattaaattaacaaaaaataaaatccaaagctgaaaagaccagtaaaactagcacattcacgtattactgctggggaccgttatctattaggacaatttggcaatagataccaagtgacatacaaatgcttattcccattgactcaataatctcacttttggtactttatcctgataaaatcttcaaaagaagatcaatatactatatgacttaaaatcttcattaaccaaagcagtaaaaaaatgagaaacaggccgggtgcggtggctcatgcctgtaatcccagcacttagggaggccaaggcgggtggatcacgaggtcaggagttcaagaccagtctggccaagatggtgaaacaccgtctctactaaaaatataaaaattagccgggtgtgctggtaggctcctgtaatcccagctactcgggaggctgaggcagagaattgcttgaacccaggagatggaagttgcagtgagccaagatcacgccactgcactccagcctgggcgacagagtgagactccatctcggaaaaaaaaaaaaaaaaaaaaaaaaaaaaagagaaacaatgtcgatgtttaatgcagggacattaaaagaacataatacatcattccaatggtccaatatgtagcaaatgtgcacagtaatcactgtaaaaagagcacaattttcttgtgtaaaaaacagaacacaatttttaactacactgtgtttatctctaagaatacataatcatgagctgaacacgaaatggaagaaattgaaaataatgcttctgaggagaaaaatcatttttgttttaatatttgttcttttgcgttagtatgatatttacagaataaaaatcaaacagtgttcttagcataatttcagcgtgtttggtgaactcctattgaacatatacaatctatatataatgtaatttctcagttaactaaaacatcctagaatcaaaccaagtaatagtatttactgcatatagcaaatagacccagattaccaaactattatcaagaagctaatgccaatatcactgacttttgctatgaaagcagaggacagtgtctaaaggcacagagcatagttgctgctattacaaaacaattaacatttatccgcgtggaatgcctgccttttcttccatactccttttatcaagcattacagtttctattctccacttttcagatcctcgcactatttgaaagcccttctgagggaacttctgccaaaggcttgccttttctagaaatatcctagggtacaaaattaccacttctttctttctcctcctcacttaagccaaacctaaagtgataaaagaaatgtattccaagatacgaaagaacatgtaattggcccttagtatccagagggtgctatttgcattttaaaagaagagcttattatctctcatctattaaattgctaattaatagcatgaacatccacaaaactgagaccaataacttggttacctttttttcaaatgaattccttttataaaacactgaattgttaataaaatacttatgatggaccagtatcagagcatatatgtaaaagctcaggaatacaaaataaaaacaaaatttttagtaaatatataattaaaatcatttattttactcaagcaagttaaataaccttggaagccacccatcactcataggttcctgtttgaaaagtctagatataagaggttataccatttggatggtttcatgggtatatgcacatgttctagcccatataattttatgcagtttttgtatatcaattacacttcaataaagctgttaaaattaaaaaacataaaatgcagaaggtgccaatgaatctaaaaacataatcaatagatcataaaaatgcctaaaattataaattataacatatcctagaattttccaaaatctctgaaagaaatagtaagctagagttaaatgacagatttcctactaaacaaggtagtaaagagtgaggcttgacgtcaaaccagaactttttgatgtactttaatgcttgaaaggtagaaatacgcgtgccatatatttttctgcaaaattgtattcacagcgaaagttaggactgttatacctaaggaaatcttgactgagtgctaaccctcactgaatactgcccaggttttgtgaggatgtaggattaaaaagtaaaactcccactgaccttgactgacattgagggggctcaggcccttatataaacacaaaggttctcaaaggtagccttttttttttttctcccttcttaaagacattccccacacagaatgttttccctttctcctacggtaatattctgcccgcccaccttgggttttacccaagtgtcattcacactaggaaccatgaccttgaccagctttgcctactgctgtgaaatttactactgggataactccagacctcagaaggagtgtaaattcaaaaatacaacagacttcacacacacccttttctctttctgaattccattgacaatggtgtacaccacagggaattgcttgtgtggtgatcatggtgtgtgaagaaatttaaaatactgtgagcactagcttataaaaaaagattgcctttgtatatgtgtgtgtgtgtatgtgtgtgtgtgtgtatgtgtgtgtgttttctatgaagaatataaaatgctaaatccccaaaagattgtttccccaaccaggaaagaaatgtttcacattcaaacccattatgctgctactgcactatgtgcttgatatatattcacagtatcttaggtagaaaaagtgattgtggactatgagacaacctgaattaatttcaagaattttgagtatttttttctactttaattgtttgtcttctctcatttcttttatgtgtaagaacttattttagtgatattgaccctacatggtagaaaagagaggaggaagagaaagagtagctaaaagcctgagcaatacaatgagcctgctgggtttgaatcctggcgtgatcgcttagtggcaaatgggagagttaattatcttttctgtgcctcagtttcctcctttgctaaatgggaatattaacagtatttatgtggaaatatgattaggtgggttaacttagagaattcagggagaacatttacaaaggtgcctggcgtgcccgaaggattaaataaatattaatcatcatcagcatcagcatcatcatcatcattactactgctagcacatctactactaattttaatgagtcaaactatattccccacagtgtgagccccttctgaatgcaaagcaagtagctcgctgttttatggacattgtctagaaatgctgcaactctaaaattctccctttaacttggaagataaaagcaagtgcatagctctatcattaaaattttaaggttgaatattggttaaatttccttttaaaatgtgttttgtgatattcacctacaagtaaaataaatgtttgttccgggtgaactattacttaaatttttaatgactgtgtctcaaaggaacttcaagaaaggcagtgcagagtaacgaaaggacatcttcccaggaagttttgcttgtccattgttctgcagtttgatcttaaggaagtcattaaccttgtaagtcccagttttgtcatctgtaaactaggatggggttacttgctctgaccatgcctccggcttgtcctgaagtgtcaaaatcaagcaattgctcggaaaattgtaaaacaggatcctaatatgcttatgaacaaaaagttctacatgttggatttgttatttttccttggatcctgtatttacattcatgaaccaagggattcatggaaaaatttaactctgttagctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacattgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaacatacatttcatgaaatatcagactttacatcttgcatccttctctctagtctcagaggaagaggcgacttttctgctattggaagttgatttcaccatctgggcacccatctattctgggatcctcctccacatactccctctctctttgtgtgttccaacttcttgcctctctgcggggaccttctctagagacttcaaacatgagtgtctctctcatctttaaacaacaacaacaacaataatctgcactctatcattttctttcctttcacagtcacactctttagaaggcagatattcactcattatctcaacttgactacattcgtgccactctccaattcatgaaaatcaggcttctgccatcatcgttccactaaaactattctgacagaagtcactatggcaaattgaattactggccccaattctttacctctccctgtatccatgccctttgctaagtaactctgaaattcttcctacgaaagacagcatgcccttgacattgagcttggtcatgcgccttgctttgcctaatcccagtgggatattactagaagtaacacaagcagaggcttgaaatgtatttatgcagtgtggctatcccttttgcacttcaccattaccttaagacaaacatgctctggactagcctactcatctcaggaggagaatgagtgacatatggagcagagcgaccccaatcaacctgcaacatgaagaagtgccaccccacccaagctgaaaattcatgaaaggcaatatgggcttattgctatatgccactcacatttgtgaaaatagttaactgattcagttaccaaaagccaatgcctatggaaagatttaagttcttatttacttgatttatttgcagcaactggtgctgctgactattctcttctcgaagttctctgctttcttggcttccactcttttggtcgcctctgtattctctgagtgttcaagcttttttttttttttttttgcctgtcctttaaatattaatgttctccaaaattctgtctctggatcaatctgatatgttggtcctcaactggagcaggaggcagggaacatactccctgggtagttgtatcataagtttttttttttttttttttaacttttatccaaatcttctacttccattgacactaccttaatttacgtccctatcatctcttgctcaggtactaaaataatcttttttattggctccctccctccactctcaaaccacccttccacctacatacaactgcgtaaatgatctttttgtaatgcaaatagaacctcatttctcctctgtgtaaaacctttcaatggtttgctattacctgcaagacaaagtcctaacctctctctttggattacaaggccctcgaatatatgacccctacctacatattcactttcatcttttgatatcttcttcctttttgagcaattccataattgtccacatgagaatataaatgctctgaaaggttaagtgacttgttcaaggtgacatagctagtcagtgaaagagtcatcataaaaatgcaggtttctggactctcaattcaggtttcatttcaattcagttaaagaagttatgcatccatataaagaaatttaaggaaaaggactgggtttattttaactgagctttgaagaatataaaacaatcttgatgattatagcatgactggaaaattattatgtataataaagtaaggcatttctgaaaaaaagacagcagaaaaatacatagtttatttttgaaaatcactaaacaatttggtcccaagaatgaattaatgttctataaatccttattgggaaaagagaagcacaatttcttccctccttgtgtgaattaaaacgacctataaaacctctttatggatttataatagaaatgttaaaatagctgtaagaaagccatttcaaaagtaaagcctctcaccattaacttcaagactcatctattaaacctctgacattaccaaacaactctgtttcagaaggtaacactctatacagggcatactatttaagaaaatggccctcattttccggcttactgaaaatgattaatctttacaatagctttgaagactacataccaacgtcgttacttttctgtcctttcaacaatgactacaagctgagagcagactagtaaatgtgttatcggccaacccattagagttccattattttctgtcttacatggcttcatgtaatgaatttttataattaaactaatggcatacaatatatttttcccctctttactttcaggccccatttctcttccagctgctttggaataagtttcatacaaaaagaagggaggagaggtctccaagtgcttcgttaccttaatttcattatgacatttttgaaagcattctctttatctgggctctctctttaatttgctgactttattaaaaggcttaagcaatactgtaattaacaaatcacccagctaccccaggcatctgagaaaagtcagttgagagggtgtagaaatggatgggtggaaacgattccagaaacaatgccagaggacagaaccccagaaaatggcgttttttcagctccttttcagaccccatgagcatattgtggtagactgcattattgttctcaaatatccagtgccttttcacgccagaagattatacatcggcattcccattgaactcaggaatggccatgtgactggttttgtctactggtcacttccaggcagaaggctcaagaaccatgttccttgcctctatgatcatgaaagaatgtaccaagatggagataccatcagccatggtccccgagtgactaagctaagtagaatgctctcatcagtctacaacgaacatgtaacatgagtaaaatatagactattaagcctctagatttgaggttgcttattactgtagcttagcctatgctgactgacatacctattcagatatgaccttatttcacatagagtagggcaattctaatacctccagacagtcctggaccaggaccagggctagaataaactagtataatgacacataaagaacaggttctcttattaataaataggaagccacataaatgttgaggaaatgtttagaacaacaatatccctgtttttctgaactacaggtaacatctcagaatatattctataggacagaacctgcctatcttgaccataaaagaaaatagctccctatccattgtgtgatggaggctcccatctaggtagcagttatgttccacagacatggctattttttcatttctatagctggcaagcagcttcatgaaagagaaaaatggagactatgtttctaaaactgtgttcataaaacttgaaaaaataagaaaagatctgtagtcaatgacatgcagatatactttttaacataccataaaattctcccacttaaagtgcataattttctggttcttaatgtattcagggttgtgcaaccattattatgatctaatttgagaacattttatttgcccccaatgaaacccataccaattaacagtccctttctattgtctattctcctcctccttcagtctttactggatgttttatatgaatgtattgatacaatttggggtcttttgtgactggattccatcacttagcatatttttgaggttcactcatgttacagtgcatatcagtatttcatttctttttattgctaaataatattccatttttggatgtagaggacattttaaaatttattcattagctgatggacatttgggttggttctactttttggctattataaataatgctgctatgaacatctgtataaaggttttctgtgtacatatgtatttttatttctgttcagcatacacctgggagtagaatggttttgtcatatggtagcttcatgtttaatatttccaggagactgggaagggtagtggtagggggaaagggggggatggctaatgggtagtgaaatttataatacaaaaatatagtttgatagaatgaataagatctagtatttgatagcacaagaggatgactacagtcaaaaaatttattgtgaatttaaaaataactgattattattagattgtcgtttgtaacagaaaagataattgcttgaggtgagggataggccaggtaccccaatgtgactgttacacattgtatgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatggagatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcctacattttcttagaagagttttaaagttttagttcttattaatatatttagctctatgattcattaaaaatatattattattataaagtttattttacaaaagttttaaaacattttatttttaattttattttgctttgacaaataattatatacatttatggggtacatgtatgttctgatatatgtatacactgtggaatgattatatcgagcaatttaacgtatctatcactgcatatatttatcatattttatagcaagaacatttaaaatctgttattttagcaattttgaaatatacaatataatattattaactatggtcaccaggttgtgtcataaagtctcaaaaacttattcctcctgactaaagtttttaaccccttttgatcaacatctccccattttccacccctaaatccacagcctctggtaaccaccattctactctctacttcaatgagtttgacttttttagattccacacataagtgagatcacgcagtatttgactttctgtgcctggcttatttcatttagtataatgtcctccaggttcatccacgctgtcataaacaaaaggatattctttatttaaggctgaataatactccattgtgtatatgtaccacattttctttatccattcatccactgatggaaacttaggttgattccatatcatggcttttgtgactaatgctgcaataaacacaggagtgaagatatctctttgacatactggtttaaattcttttggatatatacccggaagtgggattgctggatcctatggtaattctgttttcagttttttgaggagctaccatactgttctccataatggttgtactaatatacattcccaccaatgatatacaagtgttaccttttttccatatccttgatcaacacttgttatcattcttctctttttataacagccattctaacaggtgtaaggtgacatctcactgcgattgtaatatgcatttccccaatgattagtgatgttgagcatttttcacaaacccgttagctatttgtacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgacttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttcttaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtaggggagaatttttccttgcctcttccttgcttctaatgatggccgttaatcattagttttacttgtcttgcaactgtagcactttaatctctaactgtaacatcacatggtgtttttcccgtggtcagtgcctttatgtggcattcttctctctgtgtatgcctcttttcctcttcttataaaaataccatcttaacttgactgcatctgcaaagactctatttctacataaggtcacatttgcagatacctgggctcaggcttttagtatgtcttttgggagcgggggacactattcaatccacaaaaccttctttttttttttttttttagacggagtctcgctctttcgcccaggccggactgcagtgctgctgtctcggctcactgcaaactctgcctccagggttcgcgccattctcctgcctcagcctcctgagtagctgggactacaggcgcccgccaccgtgcccagctaattttttgtatttttagcagagacggggttttaccgtgttagccaggatggtctcaatctcctgacctcgtgatccaactgcctcggcctcccaaagtgctgggattacaggcgtgagccaccacacctggccaataccttctattcttcatttgttaagtgttctttatttttcaagcttgaaagggttttgtactttgtcacatgaattttctatatttattgtgatgaccatacgatttttgtcctttattctattgatatggtataatacattgattaaattttggatgttaaaccaaccttacattcctgtgataaatcttacctggttatggtagcaatcatgttaatatgttgttgtattaggtttgataattttttgaggcgtttcaagtctatattcataaggcatattgctctgtagcttgttttcttgtgatatctttgtctggttaggaagtgttcctttctcttctattttttggaagagttgtttatatgtttggtagaattcatcgggggaagacttctgggcctgagcctttcattgggagaagtttttaataccaattcaatttcttgttataggtctatccaggttatctatttgtttagttgttcataatatcctcttttacttctttttatttctgtaatgttggtagtaatgcaccctctttttctctaatattagtaatttgaccatttctttcctaaccaatcagctaaaactttgtcaattttgttgaccttttcaaataactaaatttctagattttggttttgttgattttttctattatattttcttcctctatctgatttttttcacactaattgttattacttcctgctgcttactgtagatttacttttctcttctttttctagtttcttaaggtagaagcttaggctactgatttcagatctttttcctttttaaatataggtatttatagttatacattttactctaagcactgcttcagcctcctcccataagttttggtatattgtatttttatttccatttatctcaagatatttttgtattttcttatttcttctttgtcccattggctatttaagagtgtgttgtataattttctcatatttatgaactcccaaatttacatctgttactgatttttaattgtactccattatggtcataaaatctgcattgtatgattttaatccctttgaatgtagtgagacttattttatgacctagcatatggcctaccctagagaatatttcgtgtacagttgaaaagaatgagtattctgctattattggatgaaacgctgtatagatatctgttaggtcttgtaagtttatagtctttatagtctttttcaagtgtctatttccttgttaatttgcctagttcttttacctgttattaaaagtgagatgttgaagtctccaactatttttgttgaattacctaattcttctttcagttcagtcagtttttgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcactggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggagaacaaaagggaataaagaaaatacatgaagaaatggtaggtcctggcaagaagatttctaataatgcttttcattattgtaccagaaacccaaacctcaaactactagtgtgggtcaatttgctgatttaattttgtacaactccaaaaaatacacaaaatatataaaagaaaaattcagtttccactaccgtacatatttttatggtggatgagatatatgatgccatcgatccttccacagataactaaaaatgtaaggcactacttccatatttgaaaaatgtctccctttttagtaaaataatttgagacactcaaatagctgccttagttactacatacaataagttcaacttttaaaattaattatgtgattatagaatgtctgtgtttcaagtttcctaaagaatgccttcaaaaacacagagattttgcagccttagaaatgtttattcaataatttgaaaagtattgaatttcttgcttcagatagttttcaatattatatagccaaatcagccaggctcaaacaagatttcacttctctattgaattcatgtactcttagctcagccaagcacaaaacagctaatgctgtcacgtttgaaaagcttttacgctgaatttgacacaaaagcaatcacaaagccgacaaaaaggggatttctctttcaaaaactgacaggggaaaaaataaatgaaaactcggagcctgggaaaatctctcttgacactggaaaagaaagtttaaaacgatcaagaaataatttttccaaagaatccattgccaagtttggaccaatcttaaaagcctagggaacaggttatgaactcaaccaagaatccgccaaatgaaataaatcctatgatgatcactgttggcagttttaggtgccaatggcatactatttttgcctcttgtgaaagttctaaatggcatcatctctcataggattctgtcatagcctattggcaaagattttgattagaatgaaaatcttgtatgtttttgcctaacatctgtctttctatctcaaaagaactttattgttgtaccaggcccatagagaagataaaattaaaccatgaagccatgtggctaacaaaattaactactttctaacttcatgtttttgttttagaaaaaattaagggtgaaagaaaacaattaccaatatgttatggccgtctcttgatggcctgctaattaattgttgatactctatgccatctgcattctgttttttcaccaaatcaagactctcctgttgctgtttctttccactctgaccacgctttcaagataagctttttccacatgacatctccggttttatttctgttctgtgaataggttgttattgtccccatttattctccttatttatgtatttttgagacagagtcttgctctgtcacccaggctggagtgcagtggcgtgatcttggctcactgcaacctccgcctcccgggttcaagcgattcccctgcctcagcctcccaagtagctgggactacaggcatgcagcaccacgccaggctagtttttgtatttttagtagagacagggtttcaccatgttggtcaggccggtctcaaactcctgatctcgtgatctgcctgcctcggcctcccaaagtgctgggattacaggtatgagccaccgcgcccggcctcaccattctttttttctaaataaaaggaggagttttttctaaatgtcagaccagcaaggacataaagatggaaattaatgaaataatataaagaagttaaaataattattaaaagatgtttaacaacattgataaatatttatgcaatattaagtttacaaatcagaatttaaaatttaatttacattatgtagacaattaaaatatatgtagataagaactagaagagactgtcaataaagattagcaattatgaatcattaattgctttttggtatcaagcatttttggtaattttctttttacgttcaggtatggtgactggctcaaattttaagagttataacagtgttggtggttgggtttgaaacatttcattgttgctcagtagtgagagttagtgtagtcatcactgaggtgctgcaaaggaggctggctgctgtaatcacagctctccaaggctgtagacatagctttgtgattgccttgtgaggctcacaggctctcttgttaatcttaggcacacagactcagaaagaacttacggagcaagggggtgttgctttagccatttaatgtctcctcctgtctattttcacacttttttcctaaaagaaaattttaagtaataagccagctaatatcacttagtagtgatgacacattcgatgtaaagaccagataaccattttatttgctccctaccttttagaagaattaaacattgtcgtttcattaaaaatgaaatgcagtttgcaattattgttttattttttcatcaaagaatataatatgaaattttttttcgcagtatactatttcattgctttcattttctacctgttggtttatcagtaatgtaatataatcttatttgtcaattaataattacatgagtctttttcagattcttatggggttttcttgctttgttttagccacgtagacaattggaagaggaagcctgtgaggtcatctacaagagtaattgctatgcattcgcatcacaactctactactttcaaaagaagattctgaacttctctagccttcagttttcttctctgcaaactaagaataataagagtacttttcaaagagtgtttttgaaaggatgaaataaaccaatatatataaagtgactagcatactttttgacacacagcaagcattcactaaaagttattattaacattaggattactttaattttagcatacatcattcaagaaatggatgaaaaaattacagctttggccatctttatctgtatcgggaacttacattgaatctgcagcaatacacatcattaaattcctaaacacagagcacaaacaaaaaatgtcaatctctatagatagtggctgagccatttttatgatgtagttttagaccattccaaagcgttttttttttttaatttcaaaagtttgacaaaggatagcaattataatacaattctggttttattttaggtgattaaaacatcttacatgttttgacaatgcaattgttttgttttctactttcatatttccttctgcagatatttttgtctcttatttaaagctacttgctcttctaagagcaattaaaccctaaccattcttaccatcactttaggattttcttaggttaaatttatttctcatttgctaactaccagagtcctcttgccctagtcaaatctatcactgtatgcctctcatctctccttcttctcatctaactcaaggatccagtccaaacttcgtattttctgcttataccttcttaccagttaactactttggtttgtgatccaatagattcatagtatccgaaacttatagagaagaaaaagaagtagcataacatgctgactacctcacgaatatgactagagctttcaagaataaccacatgattctatatattacatagtcagaccaggaattaggaaaatgaccattggagattcctaattcatctatgctcatccattgaaaaaaccattagtggtaacatgtgtctcttgaaagaatttttattcacctagattttgactccaacagagctaatgataagactgtaaaattctatgtggctttctaacatcctcatcatataaactaaaaccttgtcctcatagcagctcaggtcccttcgataaaatggctatgacagagattggctaaaagctcactaattccattaactcttcctgaaattcaatcgagaacaagttctgtgtgatgggatgtggtggaagtgatatacataatttccaggcctggccataaaacaccatggattgactgaccacattctgtcttccttttctgcagtggcttttggcagtgtgttgaaaatgacaagtgtcacaaaattggaaaagtctgggtttccaagtgaccatgttgggggacagctcctaagaatggcttgtcaacctctactggactatgatataaccaagaaagcagtctttattgtgttaagctattgagatttcagagttcatttcttactatagcttagcatagcctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgctgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgacttcatgcaactacataaatacgtataccaattttgaagtgatcttaaagatggtgcaacagaaaaccagccaactatatccagattactaaacaaaattaactttaacattgacattagctgtcaattttcctctattctctaccttgactcaaaagtctactggctaggcatgctaactcatgcctgtaatcctagtgctttgggaggccaaggaaggagaattgcttgaggccaagagttcaagaacccatctctacagaaaacaaaaatttttaaaaaattagccaggcgtggtggtacacgcctggctagtagtcccagctactagggaggctgaggcaggaggactgcttgagccccagagttcaaggctcagtgagctatgattgtgccactgcactttagcctgggtgacagtgagactctgtctctaagaaaataaatatacaaagtctactgttcatttcagctttaacgtgattttctgttaataactttacattaaacatcattaaattacaatctatggtataattttatcaaatgtaaccagtattttattttaaaaaggtatctttgatactaaccttggtttctgtgattttcttttggattgcatctactgtatagggaccctccttccatgactcaagcttggctctggcctgtcctaagacctgctcagcttcttccttagcttccagccattgtgttgaatcctttaacatttcattcaactgttgcctccggttctgaaggtgttcttgtacttcatcccactgattctgaattctttcaactagaataaaaggaaaaataaatatatagtagtaaatgctagtctggaggagacattttaaatgtaacttccaaacgttatctcacatttatgttgcttatttaaaaaattattcattgtgttatggctaggatgatgaacaacaggattctttgcttttttgatggcaaatattagtttctgttaaattattttcctgaaggtgacatagaacatcaacatatatataaaattttaactcaattcttgatccctagaaccaaatatgaatcatctgttagaaaagcactacagcagaatatccatatcccctcatccttgccacttcagcacccatcagcctgatttcccagtgccagcatttcattgcctgaaggctttctgttgccacaggagtttgctttgccatccatgtgacaggctagacataccaggcaactgatgcctcccctccagctcccagaggcagcctgtatataatgactaattgtaggaattgggatattgttacactagctcccttgatgctaggggaaataactctgaggcatgtattttacaagggttccagagtttcccaagggataaagctccagtgacccacaacagcagctggcttgataatgcaccactctttactggctgccttgcctcacctgtctcatttttccactcttctactgattaatttaccccccaaataaatcacttgctcttaaaaccttttccaagggtcttctgagtgaacccaagggaagataagtgtattagaaacttcttctttttctttcttttttttttttgatggagttttgctcttgtaacccaggctggagtgcaatggtgcaatctccgctcactgcaacctccgcctcccgggttcaagctatcctcctgtctcagcctcccgagtagcaggaactacaggcacgtgccatcatgcccagctaattttttttttttgtatttttaatagagacagggtttcaccatgttggccgggctggtctcaaactcctgacctcaggtgatccacctgcctcggcctcccaaagtgctgggattacaggcgtgagccaccgcgcctggccaacttcttttaacaatacctaagaattcacgctgggtgcattttgtaagactggcttatattgaggctatcactggtatcattggaagtccaagagggaggtactatatagattctactctgaaatatgttcttttcaaatattaaaataaacaggactacattattttttctatgcaacttctctaagctggttttatgaaataaaaataatacagaaaacaagtaataaaactgccatctactttatcccttaagcatgaaacctgatagacattctagattctttcctaagcgtcacccaacacctcatataattagttacaaatttctctcatatataacttctttcctctttctattggcactgcaaacctctatcattttttgccctcacatccataagaggctctatatcatcctcccagacccaaatctctgttttagaatgtaaattctaccccaattaaagattaaaactaacataaatctgatcactgcactccctcttataaaacccttcaatgtttccctactgtcttctggaatatcttagctggacatacgtgttcttctatgatcttgcctagataatctgagaggtttatctacaaagcaacaaatcacaagataagcagggtataagaaaccatcacagataatacaagaaccttgcaacagtagagctgttactacatctaggcccaagggatgaggggagggaaaagtggccaaaagcagagaattggaatgagaaaccaccctgagaagagcaataaccttttgtcaaaggacatagtcagcctgtggcaacctcaaagggagggaattaggagaataaatatcttgacctcactttacctcctgtcttcaatttccttctagggctcttgggtgcctaaaccaactggaagccaaagggcatgggagcccaatgatgacagaggtcagcctcccagaataaagagcaagggagagaaggtcaaagaatggctacagatggacaaacaaaatgtatatggcacaggaatataaaactatgcttcttattttgttatgtaagtaaagtcctttttaattaaccctgttgcctccacaaagttatgtgaagttataagttaaagaaatacttgagatggccaggtgcggtggctcacgcctgtaatcccaggtctctgggaggccaaagcgggtggatcatgaggtcaggagttcgagaccagcctgaccgacatgctgaaacccagtctctactaaaaatacaaaaattagcacacgcctgtaatcccagctactcaggaggctgaggcaggagaatcacttgaacccgggaggcagaggttgcagtgagccgagatcatgccgctgcactccagcctgggtgacagagcaaaactccatctcaaaaataaatacatagaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgttccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtctctgattccaatttgccttcgctttcgttagtcttaattactaacattttactatgctagcaatattttttagaatgcctagtggttttcacataaacatagcaagctcttttgattcatgccagtaaatattttgtacatcctacagttcatttcaatagggaaaacagtctatatttttaaaaggccatctctagatattaggaaaagataaagcagttcttcctattatgtaggaagataattttaatcctggaaaaagaaggaaacttttataacctgaaccattatttcaggcaaacatgggatttgaatgcttgctcaataatagaaggctttcagcaaaaaagtggtcatatgtgtgttatgtagcaagttaaaatggctccttggggtgtgcatcccactgagggtatgctttttcacccttgaccttcaactgtacattatcataatttattagttaattaaaaatatttataggctagagactcactcaataatccatctatccctctgtgcatccccacacatccatccatgtagccagctagtctctattttatttaccatctgttagacaccagccattatgataagaacttggaaaacaaaagggtttaagacagattacctggcttctggtttaggtgcctgttagatagtggtgctattcactgcctatccaaagaatgcagagtgagcatggagaagataatgagttcagttttggacctattcactgggaggttgtgaggaacacacacataaaactaacattttagtcaggaggactgaaggatctatagcatagctgtgtattttgggagagacagaaatctgggattggccgtcactacagagaaataaaaagcaaagcctcaaatgcaagtgcattctcatttatatggcacatagactgagcccaacaccgggctgggaatggactcctggaaaatacaacgtaaaaagaataaataaaacacaaagagcaaataagatgaatgaaagactagagaaggaggaggaatatcaagaaagtgtacttttatagaacatggaaaagaaagattttcaaaaacacaagagtgattaacactttcaaatctcatagatgtcacaagacataataaaaatcataactaacatttatttgaatatctacactgtctgaagctctgtgttgttctttccttgcattaatcacttaatcatcatacaatcctataagtataattgtttacgttctttttctattgctgcaattatcctcatttaacaaatgaggaaataaagacagcgttaaataactggtctaaggtcacatagatagtgattgttagagccgacacttggattcaagaagttagacctccaaagcccatgccaaaagtatccattggctttggccacatggaattccctgaagaccatacacaaaatgatttcagtgcagtggtagaaatcttactgtaggagattaaaaaatacctatgaaaaagtaaggacagtaaattgtagactatccaaccatagatcattataagaaggaagtcagaggggagtttggtgtcaagagaagttttttcccaaatatggaaaacttgagtatgaatataggtattgattggggaaaatggtcaaaagacaaagatgatgccagatggaagaaaagtccctgagaaggtgcgtgtattgaacattaactaactacctccttctcctgtgtttcccctgttatttttccatttgtgcagttttcccacaatagacctctctttgctctgtggatggtgtgtacttagttttaactcatctccctggctttagtggttaattcaaagatggacttatggttccaagtaaggtcaatcagaaccaatgaaacaactctaggatttttgttgttgttgttgttgttcgtgattctaaaagagaaaacccattgcttcttgtttaagatggatgagaaagcacgtagttctgcagtatcctgatatccatcttagaacaattaagaggaattaaacggaacaaatactggggagcagagccatgcaatggagaaggaaaactagaatctggtcatgctatttaattcctgaatcaagcctcgtctatctttcaactgtttaatgacactgatcaatacattttgtctgagtaagtctaagctactttgaaatggattttccattactacaatgtacaagttctaacttatagagagagacaaactcttttgatgtaaacaaaggtctcctaggaattgtacaagaatcatgggaattgtacatgggaatagctttcaaatacaaaagtttaaaagaggactttgatcctgcttaaagtagctttaactagggtatctagataaatacactgaatgcttatatcaccttggaggagttcctacataaaaaatttccaaagcccatagaaccaaaacttaccaaaaatgttatggcatttagacaacattattctgtgagccttatgggtaggaagggatttttgccaccaatgtttacctctttctattcaatttctttatattatgaatacataaatgaaaatgacactcaaaaagagagacatctggggacaaaattatcccaggacattcacatatagggtggccacgcctggttacatccatggtttaaaataattctactctttttcccttttaagtagatctttgataacggaacacccactcaaatgtcatcatcacatataaagacttcccctgctctcatatgtgcagtcattttctctcaccgtggttctcccataacactttgttaagattttaaaacttgtactgtgtgctactatgatttacatttttacattttacatttctgtctctgactctagacagtgtccttgcctcaaaggcaaggacagaatctgtagaagatgctgtcagggcccatctatctgccgttggcactcatccttcaagtatatgccagcagtgtcctagtacaagcatttgccctactgcaaacctgagagattttcctcagcttgctaggtgcgctggccagaagtgctggaaagtttatgtaccaggaagcatttagccaatgatggataagagttggaatagttagccctggttccttgcctttacccccttgtggttgacaactttgaggcatgttttttgtttgtttgtttgtttactatctcccagagctccttcatcaggatcaaaccccagtggcccaaagcaataactagttccataactggcttaattattggcttctttcatttattatctcattgtcccactctcctactggtacttcctgggatcacattacaaccaaaccactttcaccattaatcattgtttaaaggtctgtttctgaaagaagctagcctaagttagtattttatccatttaaaaaaatccttctctggcaaagcggaagaagctagaaaataaaaataaagtaaaaagtaaaaattaaaaacatccttagtgcacaaactagtgtttggcatttggaataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttgtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctagggagacaccagctggcatggctaagggagtggttgcaccatacctcccctactcccagcagtgaagcttgcagcaacagaagtgactccttacttctcgttaaggagaagagagcgaaaagtaaagaagactttgtcttgcatcttggataccagctcagccacagtaggatggggcatgggcagagtcatgaggcccccattccaggccctagttcctggatagcatttctagacacaccctgggccaaaagggaatctgctaccttaaagggaaggactcagtcctatcaggattcatcagctactaactaaagaggccttgaacgttgaataaccagttgcaatacccagggagtacactgtgggacttggcctctgagatgtgctggcttcataggtcacccagcaaattcccagctgtggtggttatggtgaaagaccccttctgtttgagaaaagtagacagaaaagtaaaggggactttgtcttgccccttaggtaccagctcagccacagaaaggcagagaagcaggcaggcttctgggatttctgagtcctggcctaggttcttggacagcatttttggtcctgccttgggccagaggggagcccaaggccctaaaatatgggtcccagttctctcagcattcaccacaagctgatggaagagcccttgggctttaagtgaacaccagtggaggccaagcagaaccctcatggtggtgagggccacagggagaggatcctctgccttttaaaagggcaaggaagagcagggagcactttatattgtggtgtgagtgctagcttagccacaatagaatagaacatgaggtaaactgctaaggtttttgactccaatgactggccctcagacagcatctctggatatgcccggggcctaagatttccaccgaaaaatctgctgccagatgtattgaagctccactgcatgttatttgtttcctttctcttgctgcttttaggattctttctttatccttgacctgtgggagtttgattattgcatgccttgaggtagtctctgagataattctgcttggtgttctataactttgtcgtacttgaatgttggtatctttctctgtttctgaagttctctgatattgtccctttgtatcaactttctatccctatctctttctctacctcctgtttaaggccaataactcttagattgacccttttgaggctattttctggatcttgtaggcagacagcctatttgaaaatacacagccagagaagacaaaagaaaaaaataataagaaacaatgaagcatacctacaagatccagacacaaaaaacccttcaaaaaaatcaatgaatccaggagccagttttttgaaaagatcaacagaattgatagaccgctagtaagactaataaagaagaaaagagagaagaatcaaatagatgcaataaaaaatgataaaggggatatcaccaccgacaccacagaaatacaaactaccatcagagaatactataaacacctctacgcaaataaactagaaaatctagaagaaatggataaattcctgcacacatacaccttcccaagactaaaccaggaagaagttgaatccctgaatagaccaataacaggctctgaaattgaggcaataattaatagcctacaaaccaaaaaaagtccaggaccagacggattcacagccgaattctaccagaggtgcaaagaggaactggtatcattccttctaaaactattccaatcaatagaaaaagagggaatcctccctaactcattttatgaggccagcatcatcctgataccaaagcctggcagagacacaacaaaaaaagagaattttagacaaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaacgacaaaaaccacatggttatctcaatagatgcagaaaaggcccttgaccaaattcaacagcccttcatgctaaaaactctcgataaattaggtattgatgggacgtatctcaaaatagtaagagctatttatgacaaacccacagccaatatcatactgaatgggcaaaactggaagcattccctttgaaaactggcacaagacagggatgccctctctcaccactcctattcaacatagtgttggaagttctggccagggcgatcaggcaggaaaaagaaataaagggtattcaattaggaaaagaggaagtcaaattgtccctgtttgcagacgacatgattgtatatttagaaaaccccatcgtctcagcccaaaatctccttaagctgataagcaacttcagcaaagtctcaggatataaaatcaatgtgcaaaaatcacaagcattcttatacaccaataacagacaaacagagagccaaatcatgagtgaactctcattcacaattgcttcaaagagaataaaatacctacaaatacaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccacattgccaagacaatcctgagccaaaagaacaaagctggaggcatcacgctacctgacttcaaactatactacaaggctacggtaaccaaaacagcatggtactggtaccaaaacagagatatacaccaatggaacagaacagagctctcagaaataataccacacatctacaaccatctgatctttgacaaacctgacaaaaacaagaaatggggaaaggattccctatttaataaatggtgctgggaaaactggctagccatatgtagagagctgaaactggatcccttccttataccatatacaaaaattaattcaagatggattgaagacttaatgttagacctaaaaccataaaaaccctagaagaaaacctaggcaataccattcaggacgtaggcatgggcaaggacttcatgtctaaaacaccaaaagcaatggcaacaaaagccaaaacggacaaatgggatctaatgaaactaaagagcttctgcacagcaaaagaaactaccatcagagtgaacaggcagcctacagaatgggagaaaatttttgcaatctactcatctgacaaagggctaatatccagaatctacaaagaactcaaacaaacttacaagaaaaaacaaacaaccccatcaaaaagtgggcgaaggatatgaacagacacttctcaaaagaagacatttatgcagccaaaagacacatgaaaaaatgctcatcatcactggccatcagagaaacgcaaatcaaaaccacaatgagataccatctcacaccagttagaatggcaatcattaaaaagtcaggaaacaacaggtgctggagaggatgtggagaaataggaacactttacactgttagtgagactgtaaactagttcaaccattgtggaagtcagtgtggcgattcctcagggatctagaactagaaataccatttgacccagctatcccattactgggtatatacccaaaggattataaatcctgctgctgtaaagatacatgcacaggtatgtttattgctgcactattcacaatagcaaagacctggaaccaatccaaatgtccatcaatgatagactggattaagaaaatgtggcacatatacaccatggaatactatgcaaccataaaaaaggatgagttcacatcctttgtagggacatggatgaagctggaaatcatctttctcagcaaactatcacaaggacagaaaaccaaacaccgcatgttctcactcataggtgggaattgaacaatgagaacacctggacgcaggaaggggaacatcacacaccggggcctgtcgtggggtgaggggacgggggagggatagcattgggagatatacctaatgtaaatgacaagttaatgggtggagcataccaacacggcacatgtatagatatgtaacaaacctgcaagttgtgcacatgtaccctagaacttaaagtataattaaaaaaaaaagtaagttgtgatgttagaaacataaaatgtgggaggagggagagtcaaagtgttgagtatatgcacacaatcaaatttaagttattatcagcttataaaatgttttatgtaagcctcggagtatccacaaagcacaaacttataatacatacatgaatgataaaaacaaaagacccaaagtatactactacacaaaaccatcaaaacacaaaggaagacagcaatagaggaagaaaggaacaaagaatctgtaagacaaccaggaaacaatgaacaaaatgacactagtaagtccttacccatccatcattattttgaatgtaaatagattaaactctccaatcaaaaggcatagagtggttgagtggattaacgacaacaacaaaaaacaagacccaaatatgtgctgcctacaagtggctcatttcaccttaaaggacatgcatagactgaaagtaaagggatgaaaaaagatactccatgtacatgagaacaaaaagagagcagggtagttacacttacttcagacaaaataatctttaggtcaaatctgttcaaagtgacaaagaacatcattatatattgataaaggttatttcatcaagaggacataacaagtatataagcatcccaaatcagagcacctaaatatataaagcaaacattaagggatctgaagggaaacatagcctataacataataatagcaggcaatttcaatattccactttaagcaatagacagaaaaattcataagaaaacattggacttgaatgacattttagaccaaatggacctaacagacatatacagaacattgtgccctgaacagtaggaaaatacagattcttctcaagtacacatgtaacattctccaggatagatcatatgttaggccacagacaagtctcaacaaatttaagaaaacccatcgtgtatcttttctgaccacaatataaaattagaaatcaattacatgagaaatcatataaaattaagaaatatgtggaaactaaacaatatgctcctaaacaattattgggtcaaaagaagaaattcaagaggaaattttttaaaagtcttgagacaaacagaaatgaaaacacaacatagaaaaacttctgggggtagcaaaagcagtgctaagagggaagtttatatcaataaattcctacatcaaaaaagaagaaatatctcaaatgaaatacctaacattatacctcaggaaactacaaaaagaagaatgaattaagcccaaagttagcagaaagaagaaaataacaaagatcagagcagaaataaatgaaatagagactagagaaacaatagaaaaaaagtcaataaaactaaaagttggttttttgaaaagctaaacacaattgacaaatccttagctagactaagaatgaagagagcaggctcaaataaatcaaatcagaaatcaaagagaagacattatgactgataacacagaaatacaaaggatcctaagagactacgatgaacaattatataccaagaaattggacatcctaacagaaatggatgaattcttagaaatacataatctaccaaaactgaataatgaaaattggaaatctgaaaagaccagtaacagctaaggaaagagttaaggagattgcatcagtatttaaaagttctcacatcaaaggaaagctcaagaccagatggcttcatgggagaattctacaaacatttaaagaagacctaacacaaatctttctcaaactcttttggaaaactaaagaggaagggattcgtccaaatttattttacaaggccagcaataccctgatcccaaagccaggcaaagacactacaaggaaagaaaactataggccaatatcacgaatgaaattagatgcaaaaattctcaatgaaatactagtgaaccatatttaatagtttattagaaggattattcaccatgaccaagagggatttatccctgggatagaaggttgtttcaatatatgcaaattaataaatgtgattcaacatataacagaatgaagtacaaaaaccgtatgatcattttaataaactcagaaagagcatttgacaaaattcaacatccttttatgagaaaaactcttagcaaattaggtatagaagaaatgttctccaaaagaataaaagccataaattacaagcccacagctaacatcatgcacaacagtaaaacgtagaaggcttttctctaagatcaggagcaagacaaagatgcccactctccccacccttgtttaacttagtactgggagtcctagccagagcaattaggcaggagaaagaaataaaaggcaaccaaactgaaaaggatgaagtaaaattgccccttcttgctgatgacataatcttatacagcaaatcctaaggactccactgaaaactgttagaattcatacacaagtttagtaaagttgcagggtacaaaatcaacttacaaaaatcagtagcgataacaattgttattgtttgtacaataacaacaaactgtctaaaatagaaattaaggaaacaatctcacttataatagcatgaaaaaatatttggagtgaatttaaccaagaaagtgaaagatctgcgtgttgaaactataagacactgacgaaagaaattgaagatgacacaaataaatggaaagatttctgtgttcataaattggaaaaattaatattgttaaacataaagcaatctaaagattcgacacaatactaacaaaatctgcatattgttctttatagaattttttttaaaaaatcctaaaatttgcatggaaccacaaaagaccctggatagccaaagctgtctttactaaaaagaataaaattggaagtatgtcactactggatttcaaaatgtattacaaagctataataatcaaaacagcatggcaagtacataaaaacagaccaatggaataagacaaagaggactaaaataaacctacacacctttgatcaattgatttttgacaaaggtagcaagaacacacaatagggagaggacagtctcttcaataaatggtattgggaaaactgaatgttcacatacagaataaaactggacccttatctcaccccttatacaagaatcaactcaaaatggattaaagccttaaatgtaatacctgaaactaaaaactacaaaaacataagagaagagctccatgacattggtctgggcagtggtttcttgcatatgacccccaaacacaatcaacacaaaaataggtaagtaagattgcatcaaactaaaaagctttgcacagcaaaggaaacaattaatggaataaagagacaacccacagattgggagaagatatttgcaaatcatacattagataaggtgctaatatccaaaatatacaaggaactcaagctactcaataacaagaaaacaaataaccctaataaaaaaatgggcaaatatatgaatagacattctcaaaagatgacaaacagcatatatatatatatatatatatatatatatatacacacacatatatgtataatactcaacatctctaatcatcaaaaaatgcaaattaaaatcacaatgagatatcacctcatatcttttggattggctattatcaaaaagttgaaagataacaagtgttcatgaggatacagagaataaggaaaccttatccactattggtagtattgtgaattagtaacggcctccataaagacagtatgaatgtttctcaaaataataaaaagagaatgaccatatgttccagaaatcccacttctgggtacatactcaaaagaaaaggagggagtgtattgaagagctatctgcactctcacattgttgtagcactgttcacaacaggcaagatttggaagcaagctaactgtccatcaacatgcgaatggatacagaaaatgtggctcatataaatgatgcggtactatttagcaataaaaaagaattatatcctgtcatttgcaacatcttggatggaactggaggtcattacattaaatgaaataagccagtcacagaacgaaaatcactgcatgttctcacttatttgtgggatctaaaaattaaaactattgaactcatggagacagaataaaaggatggttaccagaggctacaaagggtagtgtggaggtaggggataggtggggattgttagcggctacaaaaaatagttagaaagaatgagtaagacctagtatttgatagtgcaacagggggactatagtcaataataatttaattgtacattaaaaaataactaaaagtacaattacattgtttgtagcacaaaggataaatgcttgacaggatggatgcctcattctccatgatgtgcttgtttcacattacatgcctatatcaaaacacctcatgtaccccgtaaatatatatacctactatgtaccccaaaaaattaaaaataaaaaaaaaattttaaaaacctaggaaattctgtcatttggaataataaggatgagcctggaggacattaggttaagtgaaataaacttggcacagagagacacatatcatataatctcatttgtatgtgcagtttaaaaaaagttgaactcatagaaatggagagtattatggtggtgatcaaaagctgcagtggtgggtggatggaaaaatgagagacgtttatcaatgggtacaaagttccagttagacaggaggaataagttctggtgttcttttgcacagcacaggaactatagctaatattgtcatattgtatatttccaaatagctaaaaaggaggattttaaatattctcaccacaaaaatgagaagtatttgaggtgatagatatgctattagcctgatttgattattccacaatgtatatatatggattgaaacatcacaatgtaccccataatatagttgtcgactaaaaacgaaataaaatttttaaaatgaatattatttgagttgtaattccactcccaggtgtatatccaacagaaatgcatagttattaatatattcaccaaaaaccatgtactagactgttgatagcatggctatggattgcagaattgttgacagcaatttcctcatgttggaaactactcaatttctcatctatatcaacatgtgtaaatacactgtggtatcaatagaatattattcagtaagaaaagtgaacaatccacaactacatacaataatatggatgaatctcacaaacatattgttggggggaaaaatacagccacagacaagtagatatgactgttcgattccttcatataatacacaaaaacaggaaaaagtaatagaaaacttttgaagtaaggatagtagtcacccttgtgaaatgttcatgactggagaagacatgaagggggatcctgagcttctggctatattatattatgtttcttgatttggatgctatttacacagttgcattctatttatagaaattcactcttctgcatatggctagccagttctcccagcaccatttattaaatagggaatttgatttgtgaaatatattctacatacaactttggacaattcatcttttttaaaaaaggtgtcacgtgtgaaatatgtgtcattttggctgctgtgaataataaaagatgcaatcattctgctacaaacacaatacgattttgactgtacattgatgtgacaaagaacatttcagaaattcttattggacagtgaactggactagattcacagacacacatcagcacatacagacgaatcaagcagctattctgctatttaataaaagaaacaaagcagtacaattgattgttatagtagtcccaagagtagaccctgcagaaatatatacaaaagacaattttagaagttttaaatgtatttcattttgtcaaggaatgaaagcaaatctaaaatctgaagatcatcagagcgaagctgttatcctaaaagtggatcagtgtggtagtctgacatcatatagacctggtaattgtccataactgagcatcaatttatactacagaattttaccacacttgcgacacttcacccaggagactgacagatcaaaaacatattatggcaatgtatttggccactagagcccatattgttagatttacatttacaccaaattcatctgacatacaaaagtgaaataataataaagtatatgcacataaacccagacaatctgtgcatgtttgtaattgaagagctacccaatgtacacattttttttttctcacaaaggtccgtcatggaaagcttctcgactaatttgtgcagtaaatagatgttgggtaataaagggaaataaataaccaatgctaagactcaggatgacagactgagacccagcatgtgtcctgatttacgaacctccagaagtgtcaaattggaaactcagcaatcatgtcaagaaccacaatattgcagagaaagaaacagttcagttgattgaatacgaaccaatctttcacttcaagttttttagactagctatgtttaattatcgatatacattcttgactgatataaattcccacaacatctctcttagggaggaatgttatttatacacaagaaatgattaccttttgaatacacattgctacagaacaaagaacagttctgttgcaatttctgcactgactgtacagcacgagaattagaagtctgtgtaactgatttttagaaagcaactttgactagcagttagtcttgggttataaccctggattagcgatgaaatagtggatttaaatgggaaaagttgatttgccacgatctcagtttcctcaactcccaaactgaaataatgacaactgcagaaccacagaattattgtgaagataaaattcaataatgaataaaagcataaaggatcctactaaagcaaggtgctactgcttctctgtatagacaagactaaacaatgaattatagttatcaacaaacattcacgatctgctagggagtgcacactatggatctcactgatcccacagagtacgccagagttccaggtagaaaatgccaaggtgaaaggcttaaattgcaggtaaatcttttgaggtcatttgagtgagtgaagagtgacggacatgactaactgtgggcaactctaaaggaaaaatgatcccaattgcagttaagacaaagatttctaaactatttgttgggatcaggaaaaagggagaaatagcagtagactgttctccgaggctaaaaccatcaaaaaatgttaggcatgatcaagaatgaagctgaaaacaaggaaaccaccattattgtaaccttgtacaaagctaggacacaactatacctagagtaatgtaagcataactcaatgtttgacatacaaagacatataaggaactgaggaaagtccaaataataacacagattataaggaatattaagatatgtcccttctacttccacaaggcatttaaacagggttctgtggaagacctatctatagttaagctttgcaaaagaagtttcaactcaaacccacaaagaggaagaaacatatatgctaaccatgtagctagtatgaacgggcattttttttcacttagatatagaaaaggaggaatgtggttgttttacaaatagagaataaagtatctgagatgtaacagatcaaaaagctaaaaacagaggggagttattggcacataaataaatcctggccactatgatgaccaagttgctttttctctaaatcccaaaaagctagaatgcagaaacagccaagcattttggttaagttcatggaagccagacccagaacaaatgactaaattttaaaattttataatattagcctaacatttaaggttagtttggaacatggaaaagatcaacagtttagtgctattttcacactgtttactcctctattatatggggataataacaagaaaattaataatctagaaagataaaaggaaataatgtacacaaggcactgagaaaagtacctgacccctagacagctctcaattataggggcgtaaataggcaatcgtgtactttggtaacactgttggacttttctggggcttcttaaatcctgagtcataaagcaaaggaggatagattggatgatccctggagatgttttcagctctaacagtttgtgaaatacgtttcttgatgcctctgtcagagctgaaagctcaccttacaaggtttttgtgaagaactcacccagcccagtgcctagatgaacaaatgacgtatcaatagccatactgttcccctggatggacctttggtaaatttcaacttggcaatcttatggtcatatattcagtcatgctacatgtcagttaaaggaaactcaagccaacctaaaaaatgttccctcctgtctgggccaaggctatttttttgtatcttaagagaggcatgtgtcacacaggtatacccattcatcaaaactcatttcataatacacatgagatttacacattctagtctatacaaattttgccacaaacaaacaaacaaaagaaatgtgaacaaatattgagctctggttaatgacatgcatgttgaagaacttaggggtaaagggaaccgatgtcaccaacttactttgaagggcatcagaaaataataggggttggcgggtagagaaagaagtaaagtgatacaacaaaatctagagagtgggttcatgagcactcactgtacaattctttcagctttctgtgtatttgaaaaattttaaaatagaatgttagataaaatgttctctcggctgggcacggtggctcacacctgtaatcccagcactttgggaggccgaggtgaacggatcatgagatcaggagcttaagatcaacctggccaagatggtgaaaccctgtctgtactaaaaatacaaaaattagccaggcgcagtggcaggcacctgtaatcccagctactcgggaggctgaggcaggagaatcgcttgaacccgggcggcagaggttgcagtgagccgagattgcgccactgcactccagcctaggcaacatagtgagactctgtctcaaaaaaaaaaaaaaattctctcacagaaaacacaaagcagtgtattatttaagcagttttctgaatcactaacaccactttccaatgaagaaaaaaataccatctgtgggatatggaagtttaaagatactaaacagaacttatacgagtggaaatggcaaaacgttttgctcaaagtcacaatgtgtatggagaggagttggaaatggaatttaggcaggtctcttaattttctaatcaacagactgtcaaagaccagattacctccttaaaagtatgctgaatattctaatagagaaaatgagttaaccttctaaagaaagctcattctcctgttttggtaataaaacatagggaagtatgtattgcttcccatacggaaagatgagctgggtgagaggaggattgggtttttaccactggttggaggataatagattatgaaaaaatatcaacatccagtcataatgaaacatgtaagttgttttattaattaaataggtgaatgctgaaatgtgatattatttgatcacattaaaatgaataatttttttaaaaacataatgacttctcttttgggggtgttggaaactattgcttaagatgaaagcctgaagttaggagaaaagcttgatgtatatctatgcaaaaatatttcagtttatcatcttaggtcacttacaagtcacagaaaagaaactatctagatgtgataataggcctaacatatcattagatgatccatcggtccagcatctcagtcattaactaattaagtgccaaatgtagcaaataaagtactaacaactcaaaagtgttcagcaagagttcattaaagcgaagctaaaggggaccattataattctagcaccacagatttattaccatgtcaccagcatgcaatgcacacaataaaactcattcatcactgtaaatttgcacatcaaatttgatgcatttgttggaatataaatatttttaaaatcatgtagaataaaaagcatttttttctcccttagcacacactgaatttcatatctacaccttgccacttcaacttttacttgatgagtgcagaaaacggaaattaaccccgaaaaacaaagtggcctcactcttatttttacaagcatactccaccatccaactattcaagttaagaaataaaaataaatggaaaacaatttcttgaacagaaactatggctaaaaagcacaattccatacattgcttactgacagaacttttctgtatttcaattcttccttacctccttctcttcagatttaggtgtccctcctacccatgcctaattccctcgctgtactcaatgttccagtctcttccatcttctatgagaagtgattccatcttttacccctcctatgtcttcaatctccgtctacaaccatgtttattttaagaagaaaacaaccaaaaccaaccaaacaaaagacaaaagagtattatttcctttggtcctacaccccacctgcgtcccctgatggaaaccctatgtcttcctcctttgtgggagagtggcttacaccagtgctacttaaaggatggtttgtgtatgagcagcatcagcatcacctgataacttgttagaaatgcagaatctcaggctccactctagagctaatgaatcaaaatctgcattttaaaataagatttttcaggtgattacattttgagaagcaatagtctatacccactatttccacatccacacctcacatacccttctaaaccattacgttttggcttttgccactgaaattacttttgtaggtgatagcagtgaccttaaagttgctacagtattagagagtctaaagtctttatgttttcagatatcccttcagtacctgccaattgacgaaccctctttgaaaccttctcttttgattaatatggaagattccttcttggattttattctgcctatttggccactcctcactctcttaggcccattccttaaatgttgctattccctaggggtctccctttgatctttttgttttcactttacatattctctctggtgagttcatgtatgtatattgcttcatttactatctctaaaataatcagagtaaaatctgtgttttaagctaagaattgtctcttgaactctgtatccatagagccaaacgcctactaaatctctatgaaatagccaacatatccaaactggattacatcatcttcattcttcctctcccctaatcactgatacacatctgttcctctacttagtcactgaaggagaaacatgcaaattatccttcattcttctttcttccttatactttaaccaagaagatgccgagtcacttctccttaatagctcttctggcctctatatcattcatctctctcttccctagattgctttagttaaaagcctcctgatggtctctctagttcagcggaacacaaccttgtctgtgcatttgaatcaagagggctgctttaaaaactacgaatgtctgggccctattaaggctctgatttaactggtttggggtggagtccaagtattggcattttttttaaactccccctagtgattctaacgtgcagccagggatgagaaccactgatttaatgttagccttttgcactccccatccttctttaaaactctagtcagagaagtcttttttttttttttttttaatagggagtctccctctgtcatccaggctgaagtgcagtggcaccatcttggctcactgccacctctgcctcttgggttcaagctattctcctgcctcagcctcctgagtagctgggattacaggcatgcaccaccatgcccagctatttttttgtatttttagtagagatggggtttcatcaagttgaccaggctggtcttgaactcctgacatcaagtggtccacccacctccagagaagtcttctgaagatgaaaatcttggtctttcatcacttattaaatttccttaatgtcatgcctcccaccccacactgctttcaggatagtattaaaactctttacctatcctacaagatcttttataacgtggcctttgtctacttttctagtttcttggcttctgctgcctgttgtgatgcctatactccagctttacagctacacaggaaggagccctaggtatgtacaatgttaccacacacctcacatttgtctaagtatttcacatgtatctcacatgtgtctatgctttctctctgcctacaatgctctctgccttttcagtttgcagcactctgctcaaaagtcactgccactagtcagttttgtcctgataattccctttcaccctatcaaagccttgtttacgtgccattccatgctaccttgtgagtttctcaagtcataaccaagaacttaagtactcatgtaagtgtccttcctacccatgcctaaactgtaaaagtgaaaatcatcacaaatatgcaatatataaacaaaataaacacatacatttagtcaatgctatgaaaattaagtatgtgatcaaatgttttgaagagtgaaaatggggcttttgtattaaggggaagatgaggaaatgaattgatgaagtgtagcctgaactgatttcttcaaatgcttctccagaaaagcaaaaagaggaataataaaaaaaaagatcaatgaattctggttcatttaacatacatactatattattaagacaaacacaggatcagtgaaaataaaatatattttagactaaaatgctggtagaaaaaccaaaaaggaaggagtatgaaagacataagttacccttcctaggctccattttcagatatttttgattgtttaaacttcagcaattcatgaatgttatagtaaatgatttgaaaaatggggagataaaagtaattctttcctcgttccaataatccccattcaagtaacaaaacagcttaatacaaaatatgtaaatttatttttaatttttttctgatgacttatcctaaaaatctacaaaatatgtaaatgaacttttaaaattagtataggaactcttacaatagtacagcagctccttaaatgcaatgcttgggtttatgggaaacaaaaaacactctgtcaattgctcccactgttttcatttacctcctggaaaatcataactatacatccagagaagaaagacctggagagagacaataccttggtgaaacatatggctacgaaatacaggaacagaatagtataatcaccttaattttaaagggaaattctcctgaaacagaattcccatagtaaaaggaaaaaaaattgaggaatttaaaataaggtaatccatgtgaacagtgctttgtaaactgcaaaactgtcagcaaataataaggtatgattgttattttctttaaaataagatacagaatagcattttgcctatactatttgcagccaagggaagatcctatccttttaaaacatataaaactaatgctttttaacccaaacaaaaagacacacatacgttgccagaacttggtctcaagcaagactatatttttctaagttctttaataaataaagagccatttggtcattcaatactgatttgtctttatatatttgttaattatttgttcctttatgtatgcattcatcacaaacttttttataatctcttatataactgagattgagttaggatgtatacaaaatcaaagctaaaaaagaagtaataaacattctgtaagtaaattacataattgagtattcacatgcctttggaatctatgctttcacgatagactccacttattgaatgcatcactaattaaaaggaaaaactaaaaaagaaaattttcatagctcccagtggccttgtgagttatggtaaagattttggtcttcaacctcagtgcaatgggaatccactgaaaggtttaaagcagggaagtgacaccgtctaatctgggcttgaaaacattagtcatgttgctaattggagagtagattggaggggagggcaaaaaagatgcagaaaaacagagtaagatgttagcataggagtccaggcacagcctgatggtgggtggtagatggaaagataagaaaagattagtaagatttagaagataaaatgtacaggactttgcccaagttcttccctctgcctagaatgcatcatctggtacatggcaggtgcttcatgaatgcttttgatgggaaatgaacagggttataaaaacctcacaattttttaaggggtcttaggagtcttggccctgccatacttttctctcttgcaggaaaaagatgaaactaatggactgtgaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaaaaaccaaagctgaaatagctaatatgagatgttcatgaaaatctccattcagggcgtcatcatcctaattggtttataacctgctgtgctgaatagttcttccactcatcctcattttgttttgttttttaacttaaaaatgaaaagttctaccaaatatcacatgttctcacttacttataagtgggagctaagcactgagcacacatggacataaatacgggaacaatagaccctggggactactagagggaggagggaggggagtgggttaaaaaaacgacctatcagttactatgctcactaacatggcgatgggatccgtactccaaacctcagcatcatgcaatactcccacgtgacaaatctgcacatgcaccttctgtatctaaaagttgaaattaaaaaaaagaaaacttctgtgttgtgaaaaggaaccaacaatgagagaaggatataggattttaaaacatagcttcaacaatgaccccagaaacctcagaggcctttatctaactgtctgactggagaaaattatctacaaggtaccacgtgtttgcaagctttcagttcaccttttaatagccacaatggaactatgaattaaggacactaagcccgaatctccctttaattctatgtggaaggaaaagtaaagaaataaacaatgattgaaaaaaaagacttacataaaagtagatggtaaaaataaaataaaggtcaagaaggtaataaataaatcatatttcctgaatgttgttctaaattgtgttcaaatttatatgttccagacagtagaaacaaaaagcaaatccttaatgatttataaatatgtaaaagcattccatcatttgtgttattactaaaaatagatgtttatatttcagctatcctgaaaaaattagaataatattaagtaggtatatttgcacattgcctttgaaacaccagagctctattttaaaaatgtacttaatttttttctaccctaaacttactgaatcagagtcttttggctcttgaactattgcatgcattctcaacagataatgacaccccaagggagtgaaaatttgttcttgagagataaaaattcttagctatttctgagtcacaatggtttattaccctctgaaagccacaatatacgggcagatctaaagcatgtctgtggtattaaaacacggatggatataaaaggaaaaaaatcaagttcacctcaatttcatgagtgataactgcaaaccactttgatgtatttccttccagttataatttcttttgctggttttctctgttttttacaaaattaggatcctatggcataaataattccatatcctactttttttcctgagcattaatgttgtaataattccctatatcattaaatactatttgaaactacttccattaaacattttaatattcagtggtaagtataaatcaatctataataaactttctccaaaaattaatgttttaatagtattagtattataaaatgcattttagattattaatcactttccagtgataaataaccaaattacaatcttaaatgatagacactaaagtgtttagtgaccaaatttcttactcagtttccatccctgttcaaacaatgccattttatcttctgctttctctctctgctttctttcttgctcttgctctctttcttttgagaagacttttgaaatcaaactttctagaatgtctgcatatgagctagattcctacttttgcagttctaaagagagtaaaatcggctgggcgtggtggctcacacctgtaatcccagctctttgggggaacaaggcagacagatcacttgaattcaggagttcaggaccagcctgaccaacatggtgaagtcccatctctactaaaaatacaaaaattagctgggcatggtggtacatgtctgtagtctcagctactcaggaggctgaggcaggagaatcactcgaaacaggaggtggaggttgcagtgagccgagattgagccactacactctagcctgggtgacagagtgagactctgactcaatcaatcaatcaatcaatcaatcgagtcaaatcaagaaaagagtgcagagtacaaagagtttgagactaagctctaagaactgggtctttaacgaagctgtaccttttattttcacttaattttcaattgattcctttgttgcattgtttatatggcaataatgcttgttcttacacataattaccattttaatttaatctagaaaaaataataatagaatgagaaagaagataaataaaaattttttctttatctgggtcaggaattggttgttattgtacagctctctctctctctctctctctctctgtctgtgtgtgtgtgtgtgtgtgtgtgtgtgtgtggtgtgtcagagagaaatatttgcgtttggggtccttatttcatttaagtttattatgctattttcaattaatagcaagttctttacatttttaaactatattttaagagtgcacatatttcttaagagttctaaatggcatatttctatttctatgtatacatatatgtttctattatatatgtctacttctatgtctatgcacttatctgtatctatctctatctctactttgatatctctttaagtctctctttttatgtacaagttcctagaggctctaagtcctaacattccagaaatttcaaagaaactagaaagaaagattttcttctgcaattacaataggataaaagagattgtggatagtaatagctatctgcaaaaataaactggctgagcctcagatagcctggggagcttgttataaatacagattcccaaggccttcttatatccctattatgtcagaatttcttatgttggaagcaagatgtccgggaatggccagtaatactagaaatctttgtgggaaatgtcgttttgaaagggttttggggatgaagtaacccagatgaatctgggggtaacaggtagcaatgtcattaacataaagctaccaactattaacttatactaacatatctgagttttatattgttctgtgacagataataggagagtgaaggtaaagctgtatatctgtatatggtggtggttgggggaaaacctcttgcagggaatctaaaaggaagccagggagcaaacatgtgctattatgttttttgtaccatctgagatgaattgtctgtttctctgtttctattaatatttttaaggtcatctagaatagtaaagatgggtagtttatgtagcttttctcacttaaggaagcatcctttcataatgctttattacccttctcccaattctatcactttgaacaataatctatcatttggtcttctggatagtcctcactggggaggacaccccgaacacattaccattattgattttcctgccagtcttgttgtaaaataatagtttgaattattatttcttctttcaaatggtttataaaccagtgccttgtgagtttgtgtagcatgaatcagtctcccagagcctgatcatctctaggtaaactactaaaatttagttgttggctatgcaaaactgaggattggacattaaatctacgacaactctgctatatgatatgaactctatcaatgacctctttatgcagtccttcctgaaatgatttatatcatcattttttaaaaataatcattaacctgaagaaagagtatattaagatattccaaatccatgagatacatagcactttttccttgattttacccatattctaaacattcaatattaacaggcattaagaatcaagaactctttgactattgataggtcatactcaatataaaatactgtttgattggctccagaccaaaaaaaaaaaggttttgtaaaattgtgcccttttcatgtctttataaagttcctagagtttatttctgttattctcaaaatgtttcctcaggagaatttagtaatatttagatccacttaaaacaatcactagttaagtacaaattagcttccaaaatcaatctgaaaacatgctgaaaacatacatctgctaaaagatggttttctcttttatgtaccccctcccatctaaaagttattaaggaagagtctgttgctatggaaacactcgatttgacaccatctgtattcaaaattcaattgctgcaagccttcagccaatctccggtttttaattggcaagaccttcccagtatgctctacaaatctttttttttattttttatttttaggaagtcaatctatacagcatattgcaatgtaaagcatcaagaaagttcacaatgcaagcctcattccattatcttaaaatcagacttgtgaagtttcaaagcattacagccttctgataattacttggcatgaggttaatgcctaaaatttattgccaagtttttttttttgcctattggatttcacacgtaaagaaaatactcattgtaagagtgactttagtattaggaagaccctgaaaaagagccttagtgaggaacttatatcacaatacacagtttagaatggaaaacaaatatagaaatcagagttaagaatgcaattttggaatagtcagactgaagttcaatattatttggaatacttgttagctactttatgtaacctttctacatcttcttttcctcatctgtaagagatctattatgaggattttaaagtacgcattttggggactacacatacttatacatatatagtatatacatatactataacggcatttgaaaatctgttaatccacatggtcttgaagcatatttctccagaatatcaagtatctgtatataagtgttgctaaaattcatagaagagaggattacaaaaaactggaattctctgaataattatttttaaataagggaaggatatgactggatattaaagaaatgtaaatatgcttctggcaggaaaatgccaaaaaaatgtatgcacagttgtgggtccaatcacgacattttgatgggatagagaagtaattcgccacaattgagcactgctgtggtttcttgggaggctctgtcaacctactaagttatagttatcctatgggaacagaccccatagctaaagataattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtatcctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacatatatgatttcttcctcaattagaagaggatggaagtggacaggtcctttactacctggggtagtgggcatggtgggcttcctctttctgtcttgctagtcttctctaccattcaccagctgctatttctcaccctaacaagggttaatgggagtggaagaagaagaaggggtgcagaaaattcttacttcactcagtactgtcactgttagagtgtgactttgtgctttctaatgtcaaatatcacttctggggtttcacggagctgaaatgtatttctcccagttttaagatccagcctctgatctacttcttctatgatatgttccacaattacttcagtagacagtcagtcaacacaaactcatctgaacctactttgtgccaaacactgatctaggttctggaaaatctatgatgaaacaagacacagtccctgctctcatgcagccaaatatttttctcctttgtactttcatttttctttgcttgtacctctaatttatgctttatatccaagttattgttggtacacatttgtctttccctagattatcaacttctttagaaaatgattaacattttactcacttttataaatcccttttccaatggtcactaaagtattattaaatgaagtaatgaacaatgaataaacggatggatgtacagagcgataaatggataaatgaacaaaattataccttcatacattgttcataaaatattgtttatattactcctatgacacatatatcctatctaatattatactaattttactttttctacctaataataaacactgtaatgaaagaggctgtatcatggtttccttggaacaccacataattcctagccccaataccttgcacactgtaagcacataatcaacatttgatgaatgtgtgaatatacttttcagtattttaaacttatatttttccttcacataatttaaatactaatgcaaattattaagtataaaaattagggcaagttgcaaatataattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagataaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaatacttttttgtctgaactagacaactgtatacatatgccaagtattttagaggatgaaattttcaattggaaatctgactcctatactcatgatgaagactgttacataatttctatgtcaaaaacatatttaaagtttacctgttttgaatggccatatagcttgttgacgtatatatttagaatcaggacacaaaaataatgaaatgatacaattaaatcaaaatgtaaacaaaatattatcaatattattaaattaaggaactccgaagtgccctatcgtagattttggtacttactgatgcaaagtattatggacagcctggttaagtcctaaaatttgtaaaattcgttacctacttaatgaagtgtaaagtcaatgaatgtgctgctttagtgatcacaacacattctgttagttgccacatgttgatatttattctacttctcctagggacaacaggttacttagtcaaacactttatatgtaacaggttacttagtcatacactttgtttatataatgcaaattctcattcccattttgtcttaagttataacataacattttaatgagttctctgtaccctctcaaaaaacatcatggtaataagaaaaagaaagttttattaaaaaaccctaatccaaattcctgctttcaagattgggggttggtggggggggagctgcgaaactgaacttcttaagattaagagctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattccagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaacttgccctcccatctccgtatctctagctgaaccaccagttctcccacttttcctactcgaatggtgtttattttttaaaaacatgtgttagcggccaggagccgtggctcacgcctgtaatcccagcactttgggaggccgaggcgggtggatcacctgaggttgggagctcgagaccagcctgaccaacatggagaaactctgtctctactaaaaatacaaaattagccgggcatggtggcacgtgtctgtaatcccagctactcagatggctgaggcaggagaatcgcttgaacccaggaggcggaggttgctgtgagccaagatcgcaccattgcactccagcctgggcaacaagagcaaaactccatctcaacaaaacaaaacaaaacaaaacaaaacaaacaaaaacaaaacatatgttagccttttatctttctaaaacgggctaaacattattttgcttaaaggcatagaaattaatgcctctgagaaattttaagtcccatgagtcaataaatacccaatatgtttgaacttaattgaaataaactatcacaaattgatagtttatatatcagtcgtatatataaaattgacatataagcatgtactttataactatctacatgcatgagtatataagaatacacacacacacacacacacacacacacacatatatatatatatatacacatatatttaaactttcaataactgactccaaatgtagcctcctttcagcataggtttggggaaagaatacccatctaacacctatttttagaatcagaggagttggattaaatcctggttccgctatctgtgtgatcttatgcaaaatattaatatctttgatagttggttctctcatttacttaataaggacaatatctaccatagggactgttgtgaaaataaaatccacttatatatgtataagagttcctcatccaattcgtataaagcacagcacaaatctaaagtattactcttttatgagatactttaaaatctgaataaagttagattttatttgtcccataaagaagtgaaaattttgacagtttcaaattgtctgaaatgtttcatattctggagttccctggaacatgtttttagttaccaaaataccaagctactgaagggaaacgtgggcattttggttgccctgccagacattaagaaaaaaatgaatcccattctatttattgctatgtctcttaaagtacgtttggcatggtacccaacattgagagacacataacctgctgtcctaaaactctgagcaatttacaaattcttgtaatcatagaaagaattccccattttacatcccaaaaggactgtgccttctcctcttagtggctcctacaagggattagactaaaccaaatccttcatgaggaacaggtaaagtgccattgctttaaaatgccaacgtgagcctatatattcctgtgctgttcatattaccttatcgttctgcacaattacacttgatgttcacattttcaggttgactgggttttatcacttcatggcacacttttctgtttaattacagagaaaggtgttttcccctcattcttattctgtgcatttgagacttgattttatcttttcaaacattctgttgtttgaacagacaattttctgataacaagtgaatcaaggactccctgcctttcctttcctcgaccagttctacgtttttctgagagccagctgtggcccagggcaacagttccatggttcctgtatgaaagagaaaaatctgactccaattgtcaggcttattgtatctaccactgccttgtatcctttgtaggggacccccaatggctttactcctatgacccagggttagacttagagatggtaataagccaaaccatgcagtaattggaaacactgaaaatagaaaattctgtatacattttgctttatcttaatattgaaagaaaatatcagagcatttcatttattcattcagagaatcttgatggaaaacctatttttttcaaggccctcgactggaatttaagagaagcaacactgtcaggaaagacaaatttctcgagcaagttctaaaaattctgtgcatagacattagaacagttaccaatattcgtgcacccattttctagatgtgaaaatttttttactcttatagctagcagggcactatcattgtcaacccttgagaaggcctagtggaactctcaataatgaggatagttgattgttatggactgaatgctggcatcccccccgccggctaaaatttgtatgttgaagtgctaacccccaatggatatttggaggtggggcctttgagaaataataagggttagatgaggtcataggttgaggcctccataattggattagtgtccttttaagaagagcaagaagagagactagagtacctctctgcaccacctctctccccaacatacgaggatacagcaagaagaaggttctcaccaggaaccacatctgtcagcaccatgatcttgtacttctcaacctccagaaccgtgaaaaacaactgcctgttgtttaagccacccagtctatggcattattttatagcagcctgagcttactaagacattaatatttgtatagtgagtagccatttgaaaaggacttttccatgcgtcatttcattgaatcctaacaccaaactagtatggaagttatcaggatcccagttttacagatgagaaaattaactgttggagagattaaataatttgccatgggtcccactgtcactaagggggcagagccagtgcttggaccaagtgctcttattttagattcagtgctgttactactatattactaaagaaataaaggccaaagaatctccaggataaaggtagaacctgtcaaacggataaaccaacatcagcaaccatttgtttcctgacttctagttttatatgagaaaaaagctcctgtttgttttagccactgaagtaatatagtttattaccttcaactaacaagagtcctaatggttacccctcagtccagtctttttgtgtaatcaggtagatagtatagctttcctctaatccagaaatcaagaatggggattaaggaaattaaggaatgaaattaaagaaggacattcttatgtatttatctcactaacataaaagtaataatcgcaattgctttcatcaccattgttataattatctcataaccaactattagcttcctaggtctttttgttaggcctccaaaattcaaaagctttctttacaatacccatattttccatgtggagccaggctgagtggacctgagataattatcatcatgtcccggagctataaagttttggtgggttcttgtttctttcaagaaacaaaaacacatgttattctgcacgtgtttcctgtacacatgtaggataaaggacatgtacaagtagtctgcaacttttagggcaaagagtatgattgacatttgtgggagtgtctaatggggatattcaaagcaacatgggatcatgtttcagaaaactcagggcaaaactcataggttgcttgtcctggggtaagccagccaccacatcataagaacactcaagtagtcccatggaggaactcgtttagagggaaaccaactagacagcaccaactcacaagctatacaagtaactcactgtgaaagtgaatccttcagccccagtcaagccatcatatgactgcagcctaattgacatctgagtgcaacatcatgagtgatcgtgagacagaacccctcaaccaagcaatgcatgaatcctgacctacagaacctatgagtgataataaatgattattgctactttaggacactaagtttggggtgattgttttacagtaacaggtaactattcaaactctttcctgacaaaagtagaacaagctcggctttccccttttcatgtagaaaggtcacaatctattaatccttcctacttactttataaatgttttacttaagacaagtacaacagaataaagacaggtggcaagcaattttcaaatcatgtataagtaaattttggtaaagaaagaagtagtaggtacaaaataataatccctacaattttctataacttgagagctgagagcattttttaggaacagtccatggcacgtgtttaacccttggcttagttttatctaaaatgcatgatgccatcagggagtaatattcctatttatgcccacaggtaccaaaatataacagaaattcaagactttagttacaatgaccctgtaggtcataagataaaaatgctagcctataaacatgtagagtatctctttctgggctcatctctgtttgtatttgtcttattagctcactttgtctgagtataaaattctttaatatatttactcataatcatctttatcacaaaaaaggaagaaaaactattttctttaattggtttatttatttaatagttttgtttattatgtttaattttcaaggtggatgaataaaacatttgttaacccagatctttccccttaaaaagaaacataatgaagacaaaaacaattagtagaaaacactatttatgttcataattatggtacatcactttaataaaaaatatttttcctattataaactcacttgaaagatttataattaaatataatcgcaacaggtaatttggattttaaatcctattcaaatatgttttgatattaatcctcttaatttaaaaatgaaatacatttatgaaaaatggaaaacattcatttcatgataggtaattagtattaatttaacacaacgtataggaagaaaaaacatacttgttttttatatatcagtttttatatacaagttacaattactctgatagaactctgaaattcattaagatattaaagaccatttctattatttaacgtatatttccaggtaccttattaactaggtactactaaaaaaataaaagaaccacgagatttatatgtgaagaaacacatgacattatgaacctcatgatgatggctgatgatggtaaattttatgtgttaacttggctgggctatggttcccagttgtttggtcaaacaccaatctagatgttgctgtgaaggtattttttagatgtgattaacatttcaatcagcagactttgagtaaagcagattaccctccacaatgtgggtgggccttctccaatcaattttgaagtccttaagagaaaagactgaagtccccagaaaaggaaggaattctgctatcggattacctttggactcaagattgcaacatcaactcttcccttggtctccatcctgccaggcttttggattttacagatttttgacttttcagctcccacaatcatatgagttaatggcttaaaatcaatctctctctctctctctctctctctctctgtatgtgtgtatatatataatattattatatatattagtattattaccaatctctctctctctctcactctctctctctctctctctctctctctctctctatatatatatatatatatatatatatctcctaattattagatacaacagaagatagatggaaagagacagcagcattctaaactctaatgataatggtgaattgataatacaggtgaaatattggactgtgagttttcagatgatgaaaacctagataaatgttctcaggcccaaggactgattaatgcacaatatatttctaatgacagaaaggaaatatgatattttaatccacttaattattcaacaggaagaacttcaccacataatattagctgtaagaattttaacaatcctgttttgctaaaggatgtgtgacagatattatgtcatttatgatgtttgtgcaccaaaatttatttgatacaaaaagtaagttgtatttcttttttattatttatttatttatttatttacgatggagtttcactcttgttgcccaggttagagtgcaatggcgtgatctcggctcagtgcaacctccgcctcccgggttcaagcaattctcctgcctcagcctcccgagtagctgggattacaggtgcccgccaccatgcctggctaatttttttgtatttttagtagagatggggcttcaccatgttagccaggctggtttcgaactcctgacctcaggtgatccatcgcttcagcctcccaaagtgctggaattacaggagtgagccactgtgcccagcctgtatttcaattcttattaaaatttctcataagattgtctttcactatctctttatacttccataagaatttgtagagtaacttagacatatacaaaataaaaagctaaagggttcattagacctacaaggcaaacagtaatggctaatttccctggtatactgagggctgcatcagaaacctggtctacctaaacacaacaatctttaatcctcagctaaagagtttctatactttattcatggtatcattaagaaccaggatgaaacttatgttacttgaatggttgtacagcagcagaaaaaggaaaccatacagtgtagcatctataaattcattatttaggctgggcgcggtggctcaggtctgtaatcccagcactttgggaggccgaggcgggtggatcacctgaagtcaagagtttgagaccagcctggccaacatgacgaaaccccgtccctactaaaaatacaaaaaaattagctgggcatgatggtgggagcctgtaatgccagctactcggtaggctgaggcaagagaatagcttgaatctgggaggcggagttgcagtgagcaaagatggcaccactgcactccagcctgggcaatggagcaggactctgtctcaaaaaaaaaattattattcagtgtgtgtctaaatgcttctatattgtaagttggcagggttgggggttgtgtggggggtgggtggtgctacctcttctcaaattccttaaatgtaaaccaacttctaggctttttcctaggttcacttttctttgcaccaggtaccctctctctgtgcaagctcagacattccaggtaacttttgaattcttgtccaaaagtaacatcactcctgcaatctctatgttttcaaccatttctttaaaatctcagtatggtcatctagcttcatgttaagcacattactttgtctcccataatcaactccttatcctgagtttgtctctggttatgacattaatcttccaaagaattcaatctccaactcttagaggcaggccttctcttagattgacagttttatatatgcaatcaatgtcaaaatcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaactgccttgcctaaatatacttgtccaaatacccacatttgattgtgagctctttaaagacaaaggctgaatcttacttttttcctgtatcccctctaccatctctgatattagatagcacagagtaggcattcaaacgttcgctgaactgaactgaactctttggttgccagcggcatcctagtggatgtgaattttgagagctgcttgtagctataacaggttgacagcaggtgctagatgtcaaaagaaggaaatttatatggttgactccacttcttctaaaataagcaaccatctaatagacaatacctgagaggaagatactggctggcatttcattagcaacagagatttcatacaaatgtggagaacaacagagcctttttatttcgccatgaaggatttcatagatttggttgcagcaatgaatgatgggttgacaaagctgctataaaactgtcagttaattcaaaaatcgtgtgagagatgtttttttttattctcatacagaagaacattctccccttctatggccctgtataccagttctttatgcaatataatgtgaattccttttcttaaaatttataagctatcactaaatttctctaagaattctggactgggttgaaaaatccttagctgaaaaaataattccaaaataaacgactccctcttaaaacttggaattctgtttcagaagtccttcccttggtttagctaataaaaggccacattatacacccttcatattctcccatctccagttctctctgtaccaaatccatctcaccataacaatatgtaccatttaatgagcatctaatatgtgccacatatttactttagaaacaccaattattttactttcttaatcaccctaccagcataagtactattattagccccacatgacagatgagagaaccacagtttaggaaagagaattaacttggctaaggttacacagctaatagatcattggggtccactagtctgtacatctccaacacatgtaaaagacaatcctttgattagacactcaaatacacagaagtcaaaagtataaacaggagcagcaaaaatgtatatccagactataattacctgaggttagtcctaatattttaagttgtcagataaatataccttcctatttttctgactaaccagccttttccatttgatgtgcctcgggctttaaaatcatatagacgtgggcttgaattctacttcctcacttgtcatcttcctaagaccctagacaagttacgttagctctccgagtctcggttttctgtctctaaaatgggagtagtaattttatctacctattaaatttatagataataaaaattttgcagtatttcccacaaaaggctttcctgaatatttgtttaattctatttatagatcttattccatcttttccaagcaaccttctcctgtcggtcttttaaatctctccttttggggtggtggtggggggcgaaataactaaacagctaccaaaaagctcattaagtattttgcattaagccttcaaagcaccccaatagattataattaaaataacaaatgctaacattcattcagcttttactatggccctgatctaagggctctacattaattatttcatctaatcctcccaacccatgagatagttataagtgagcctattttacagagaaggaaactaagagcagatagtttactgagattagtcatttgctcaaggccacaaagctaacaagtggccagtctaggcagcctgccttttaaagtaatgcatgctattgctgtatagccccgaaatggtagtggtgggggttacggagggagaagctacagaaacaaggctcttaaatccaaatgttacaggaacgacattcaccaatattgtttgtgaaataaacagaatgataaaaggaagcagttttatctttccaaatcctcttcactgctatgcaaggtattatggtattatgccttgcagtattaacagacacgaacaagagtttcatgtaattcagacgcctccaaggaagaaaatttaaattcttctaatcttatctgcttttggtcccctgacccagcccttttgcagaagaaaatggccaggaatgattgacaaattcagacaccaaagagttaaagaaaaatgagcaattcgaatattagaaagagggagaatttttcatttgatctgatttagacaaaatttactctcttacctagattattactgcatgatttccatcaatataattacctgaatacaacagataccacggtaatagtttcatatagtaaaacatggtggtggcttgcacacccaattacttgaagtttaacatgaatatttctagtagacataaatagctttgtactgaacttttctcttgatagactgcaataactatgtatagattttcccaactgttcaaagttatgaaatgggatttaccagagaaagaaaaatgtttcaatatagtattacatacatatattaactattttttctttatttagctgatttctttttgagcatttctagaagtttcatggcaataaaaaggaagaccaaaatcatcaaatgagaaaatacaattttatgagcaagtattttatttctgtccttttcctgaaaaccaaatctttactaagaaaaattctattttgaacacgatcgaaaagtttatgagtattgaatttccatcccattttatagatttcaaagggagagataaactgaagtgtagcagggctgcaaatgacattgtttagataaacatatcttgtcagaattatcctggtaccatttagaggctccaggcatatttggaactaagattccagcttagactcttaataagcgctatgacacatctcgacagacacttgcttttaagaaaatgctttcttggaccatttggattacagcctttccactaggctgcaaatattcataaaggtattcattcctaaaagacaaaagcttagaaaagaagaactattcaaatcactgaatattggcagagagatacaaacttgccctccggtcattcaattttaatctctatcatgaaaaagtcaatgcaatatgaaaaaaaaatgcaggggataatggaaaatgttcagacaatgttgaacaaatactgtataatacattcatattgtcttcctcttagggaaaaaattgaagtgatttttcattagtaaaataacaaatgactctctgtatagtatgttcagatttgcataaacctcactgccaaatttccatatttctcaggcaagaaactgatcacttacctgtgtaatgggaattcagtctcatattgagtaaatcactcactaagattcactcttttgggtcagtgtgttgcaacttgttggagaaccctcaaggttccagtatggtggaggaatgctctgctaaatcaattgtatggctatcttaccaaatctgttcctcttcctaggctcaacagtgtacactatttccctaattccctcgcagttaggtgtgaccatgtgacaagatccatccaacagaatatgaacaaaattaacacacaccatttccaggcgtggctcatgacaaattttcatgagtaatactcattcttcatctgcccattaaatgcatatgagtcttatgctctggacacaaaagatggaaggagcttgggttcctgaatgacttcatagagggctgcttattttggactgcactaaaataagaagtaaatttctgctgtagtaagcctccaagatttgggagattacctgttatagtggctagtgttactgaaataatacattagcatacatccacattcattgtttaagcaacaataaagagttaaactttcaaaaccaagaacagcctattttaattagcaatcactacaactgaaagaagacatgtctttaggaagtgaatcaaaacatacataatttcagacaaaagaagtatttagtcttagtacaatgattaaggtcattaacaaaagcaacaaaacaagatgggaaatggtaaacatactagaaagagcgcagattttcaagtcagaaagagacatttacaaattccaagctctgttctttgcttgtttgtaaacgacgcagtctcgctctgtcgcccaggctggagtgcagtggcgcaatctcggctcactgcaagctccgcctcccgggttcacgccattctcctgcctcagcctcccaagtagctgggactacaggcgcccgccaccacgcccggctaatttttttttgtatttttagtagagacggggtttcaccgtgttagccaggatggtctcgatctcctgacctcgtgatccgcccgcctcggcctccccaagtgctgggattacaggcgtgagccaccgcgcccggccgagtaactgttcttggaacctgttttctcgtctataaaatggggattataaaatatagctcacaagattctgtaaagattttgtacacacacacagaaacacacagaaacacacacatgtgcacacaccatctaatgcttatgaggtactgaataaatactagctattatcaataagtacttacccaatatgtggaagtatgactaataatattttaaaatattaaccttttactctggttactctttcactttccccaacatattgacaactagtcatttccttagggaagggttaacatagcagaatataaattatgaagatatagactctcatggtttccgagtttgaaaagtctaagcctggtaaaagacaaaagatttcaaagagaaaaaaaaagatggctgaaaggttttcctccttcctgcactacaaaggattcttcgggttgtgggaaggaaaatgaggggatattgcagaggaagcaagaaaattcaataccagtgtgtgtccctggagggaaggaaggtagagagaagtgaagaaaccgagagagatctgagagaacctgaaagcagagctgacttggacctcatttctgaggagaatctctgagggaaaccgggtggcgagtttcccctactccttcgtctgtcactcttcctgaccccatggaaactcactgacacaacacacaatcactgcgaatcactctccccattaaatggataggagtgtatgtcagaagaaaagaatatgcacagcgtctagtcagatgggtcttaccaaagttcctgcccaccctactacggcataaggtacagtacgatgatttttgatattacaaaatgggggcatcaaagtagcggagagatatccagatctgaaagtcactgcacatgggaatgaaagatggcccaggaagaagccactgcctgcttggaccaacagccaaggatatgagggagagactggcatctccatggatgccagcccagatgacaactaaagaacaaatgttctgccacaaatgttctgccacactgtggtcaccacacccatcaatgcatgctttgcaactatataagccctgaattgatttaaaaatgtatttcttctattcaatggaattacattcatttattaaaaggtaacattatggactgaaaatctcagcacaattgttatcatttacaattatttcacattatttttataaatgtgagggggatatatgaacttaagtttttattgaaacttgtcatgcatcttgctttgtgtgtcccatgcttgttaaaaaacttacttcgatccgtaatgattgttctagcctcttgattgctggtcttgtttttcaaattttgggcagcggtaatgagttcttccaactggggacgcctctgttccaaatcctgcattgttgcctgtaagaacaaatatcccttagtatcagggttcttcagcgttgtgtattccttttacataatacaaagtaaagtacaattgtgagaccagccaaaacacttttagaaataaaaaagatgttactgtataagggtttatagaaaacaatttaacaggaaatatgtttcattcttagatatcaaaaatatttcaaatgaaaatcttgactatagattttcttcatttaaaggctcaaatggagacattccggagtacctcggattacttaaaccactgtctgaatgccttgagtaagaaatgttattctgaattacgacaatgtatttaaaagatagataactatttatacttataatatcattctgtgtgacgtcaaaattaaggtatatttattttaaaaacagaaaaagcacagaaccgatttaagagatattacttatttaacttcattgtacccctgagatttctcacctgtcaaatgaaaaggtgaagtagacgagctaaatcagcttttctcctaagctgcctgtccgtaagaatcaccaaacctttttgcctccctccagaactaatgaatatgtagtggaaagggctgcaaatcttgcattttaaataaattatctaattaacttttatgatttaggcaagtttggagagcatcagattacaggttagtattcctattcccctgtattataaatgactttaatatagcactattttaaataaaaatacaaatataataaagttaacaatttttaatttataggtagtaatgtaaatcattaagatattcttccctttcttcagtgtctattttctctgtcatcttagtctctctagatttaaggaccacaatctcagaggtatttatgaagaaatttatgaaaaaaaggcatctgactagctctggttctaaaactcagtaaattttattttaattggggaaaatacaagtaatatttactgttagtttataagcaatatgtgacagatgttttatctatattttctcatttttttcttataataaccacactagtaaacaagccagcaagtttgtataattttaaatatgatgttctaccacatgaggccaatgaagatgaagagatgaaagtggtagatagtaatgtatctgaaacttatatgaaacttagttatttactctgtactttgactcctgctgattttctaacgaattttggttttggaaaggccaaattttgatcattctgtagtgtttcttctgtgaagaggtagggagacaggctttgtgatttaaactcaattgcttttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcaggtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggcagtggacaaatatattcggtatagtgtgtaactcacatgaaaaatcgtgcttttcgatacttggaaatttttatataacaaagattatctttattgggttgttcttcttttaattcactctcacataaccagattttttttgcttctcagttttagatacattattcactgtttgctatacttttttccttcttttaagatttcaaagttcatttaagaagtatgttgtaaaagtaagttgatcaactttaatctgaaccttaccaggctctaaattaaacctgaccacaatgaacagcttttattgctgaaattagcaagcatgtcaacttagactcaaaacaagccattttcctctctaatgaacaaaataggtctcagggtattgtgaaacctgttctctagttgggtgattctctaattctgctgacagacacatgctttgtaagcacctgagaagattattaatgagatcctttgaagcagcctccttaaaaatctaaggaggttcacaactgcagtacaactatgcatttctaaaatatttcaaaacaaaatttcaactttttatcccactctatggtcaacacatacaaacattcatttcaacaaagaagctgtaaaatgataatgtatattgctatgggatttatcatacactaataggctctttacttagtggtcttttagtatagcagaatgggaattttctcctttgattccctttctagaaataaagagagggatttaatatggcatacgcttcagtattttttcattaagatattataaaaacagtggttaaaagaatttcttgctaataagaacacaagcatatggtgagagtaacgattatttttcatttggtttccttttaagggtattctatttatttgctactatactttctttgacttcaacttagttttataattccagaacttctcaaataaactgaccttcacctctattccttcgagccacccacagatgagaaaacaccttagatctaatcattactcaaactacttgcctccaaaatatccatctataaaattctgttctctgcccccaatctgctacccctaccagatgttactctcccaaacatgctgttcctagtattatcttcatcctcatatgacctctggtccttttctgtttcctcaacctagctttagtcataacaaacaagtagaatgctaattgtgcttatttatttctctgatatgatcccagatatttgtgacacaaataacttaaagcgaacaaaactaaaatcattacatgcttaccagtacctaagcatgataatggatcgtgtctacatggattctatcattctagaggaaacaaaacacaggagaaggaaggaatcaatgctatttctaaggagtcataagtcagctactgggctttactaaaaactgcttaccccttggagatgagaattcatcatggattccactagctgagcaaagatggaggaaaaaaaattcttcaaatacaaagtgaatcagaagtctttaatctcactaagtccccccagagttgagtgaagtggttataaatagcaaccctatgaaataggaagttaaacagtgaaatcatacatattataactagggcattttaggcttttagacaaaattacaattttttattgtattcattaaaatagaattccacctaaataatactcaaataaaaactctatatgttgagttgaatgcttagtatttacatgtctaagaaaagactttgaaaatcaaactggtcatatttttatatttttctataaaaatcaacaatctacatagcataaatgcccatgatgatttttcaaatgttcccattttcagtaaatgaatatgaattaagctgaaatgtaacaatgtagaactgatgctattttatttacaacttcaaaaaattaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgatattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctctgtgtgtatagatatataactgtatatgtaatgttttatatatatatattttttttctgaatcatttgagaataatttgcagatatcatgcccctttacccttaaatactttaggttttatttcttaatagcaaagacattctcttaaataacctcagctcagtttcaaagtcaggaaatttagcgtggctttagtaccataatcttatccatactctatattcagagtatgacaattaccccattaatgaactttatagctatatttttatttcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaacaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttctcctcacccaatgattgggtgtggtgggaatactaaggcagagagccttccttgggagacatgggacttctttgcctggctctgcctcaatgacttcccaacagctttgccaaaatttccttccactagaccgcacactgggatgcttctgcctagccttctctccctctctcttccttgcagagtcagaattgcatcttgatctaacatctcttgcaccttccttggcttcctccttcttttctttcacatagatatttccactaataaaatattgtcccattttatcctgtctgggtacatataacctcaggccctgactaatacactcacttttgtcctcctagaccctaaacctctcatcagctcttcagttccatgtaacgtgatggttccatgacactactacctgaatgtgtaactgtcaattattgaatattaattagtaacataggtttcttcatgcctcccatgggctggcctcttaagatgcaattcaagtaaatatgtatttttacatactacctctatttagaaatcactaaggtagggtgcatgaccattatttccaaggagcgcagaatttaactggaggaaaataagagtattcagatgtgttacatggtaatggtggagttccattcaacacatgcagctcaagaactgtaggaaactaaagcaagccaccaggaatccttaacagataacaaccactaggtttgctgcaagagatggcaaaaggaactttggggcaagttttcagatgacggaagacagaaagttaagattattccacctctctgagtgagaagtgccctaggtagacaaagacctcaaccaggaccagcttcttgaacgtataacttgtgcagttagttacacaaggatctgcattagaagggattcatacttggtttcatgctctactgttgccatcttgaaattcttaatttttttttaaccaagggccctgcgttttcatttttcactgggctctacagattacgtacctgattgtgacctcaaccctaaggttagtggagaataaaagttatgtatcttggctgaagcactggttaatcgttgatgggaagaacacatttaaacacaaattaaatgacgtcaatcaaatgcctcttgcttaattcctgagaatgcgtttcaaatttctggaaggagcagttatgaagctaaaaaatgtattttgggggaaatctggcctcaggaaaagctgaacaggacagttagaagtggttccaaggtgggactgtcatcactatcaatggttattggagaacaaaagtcactataggaaaaatgaagtagggaaacgacaaagaaagtggtgaatcatctgaggaagaaattggagataaaaaggagaacctgtggcttcagcaacaatgatggctgctgaaatctcaaatgacatttctaggtttagctaagtgttagctgtttccaaggctaggatagacttgggaaatacataagaaacaactaataatttgttttagaaacatttactaaactgcaactatttgccaagcactcagctagtacacatagacaaataaaacttgtcttcttttttcaaggaacttataatctagcaaacaaatactcataaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagtctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgatatacttacaaggtactcatgtcatagtataatataaggtagctatatgatagtatgatataatataggaatggataaagggacagggatatgaaacgagaatacaaaaggggaaattaactatttcattcaaggacagattatattctgaatcagtcatggttcttgcaataaatagttcattcaaagtgggatgaggaggctttcctcctcaaggcctgaaaggctaaggggagggtatagttagtagaatctgagaagtggctgcagggacaagacctcttgacaggagctggggctgtgagtaaaggaacctagccatccctcgactcactctcctctcatccattgatctgctgatgcctcccaacacaaggaccaagccaatagacaagcaagcccaatgctactgccatattggtcaacctcctagggtagaacaacaggttagagattggatctgcgaaagtatccagcaacagtataaaaaaaataataataatggcaacaactattgaaacaaatcagtgaaggaaatgaccacatatgggaattctcagcaaagacttcatatcaagtatggcactacagctgaactttggcagatttggctagagaatgagaagagcattataagggaaagacagacatgaacaaaggcatgaacgtaaaataaagcctcaaatgggctggttagagcctggaattctttacaaataatggcaaataagtttaggtagacatagtagaagcagtatatagttggctttttaaaaatcagtttgaggttttgaattttatcacaaggacaactgggaagcagcgaacttgcagaaaaaaactgaggctataggagcaaagctttcagtaatcctgtgcctccatagattttgttctttctggttgggataaatttctcaattcttggtccattcctagaaatacagttaacagatacccatacgtaaaaagtgttgattgaccaaatcactgactacaatgaagggaaacagtggtacaagaaacaagtaattagagacttgtggcagatcaagaatacatacaaatggcaaacaagcatatgaaaaggtgctcaacatcactgaatcattgataaccagagaaatgaaaatcaaaattacaatgacatattacctcactcccgttaaaatggcttatatccaaaagacaggcaataaccaatgttgacaagtatgtgaagaaaaaggaacccttgtatactgttggtggaaatgtaaattagcacaaccactatggagaaccgtttggaggttcctcaaaaaactaaaaatagagctaccatataatatagcattcccgctgctgggtatatacccaaaagaaaataaatcagtatattgaagagatatctgcactcccatgtttattgcagcgctattcacaatagccaagatttggaagcaacctaagtgtccatcagtagatgaatggacaaagaacatgtggtacctatgcacaatggaatactactcagccacaaaaaagaatgagattctgtcatctgcaacaacattgttggaaatggaggtcagtatgctaggtgaaataaatcagacacagaaagacaaacattgcatgttctcacttatttgtgggatttaaaattcaaaacaattgaactcatggacatagagagtagaaggatggttacctgaggatgggaagggtcgtggggaggtgggggtggtgtaggtatagttactgggtacaaaaaattagttagaaagaatgagtaagacctactatttgatagcacaacagggggactataaccaataatgatttaattgtacattttacattaattaaaagagtataattggattgtttggaacataaagaataaatgcttgaggggttgaataccccattttacatgatgtgcttactacacattgcatgcctgtatcaaaacatctcaagtaccaaataaatatatacacctgctaggtactcacaaaacttaaaaatataaaaataaaacaaaaagaaacaagtaattagaatcagaaatgtgtggaaattgctagaacacatgttccttttctaagcagtatttatcagtattataaaaatcactgatcatttggctagctttaaaaataaaaaatatgatagctgtttaagaaatcattattagctattcaaacttaaaaaacaataagacagtcagtgaaatttatttctctatttctttgtagtaatgtttcaatttgttgatattttggggagttaaaaaaactcttaagcctagcactgcatgttctcactcgtaagtgggaattgaacaatgagaacacatggacacagggaggggaacatcacacaccggggcctgtcaaggggtgaggggcaaggggacagagagcattaggacaaatacctaatgcattgggggcttaaaacctggatgttgggttgatgagtatagcaaaccaccatgatacatgtatacctaggtaacaaacctgcacgttctgcacatgtatcccagaacttaaagtaaaattaaaaaactaaaaaataaataaataaatataaaataaataaaataaaaaaagagcatagtaatctcaaaaaaaaaaaaaaaacctcttaagcctaccaaatttggtgacttctttgaaatggtaataatattaatctactattagtgtgttatttttaaaataaattatctccctgtgttgaaaaaaagattaagatggtcctttccaagctattataccacacggaacttaaaggattgatttacttgtcatttactaaaacccttaacatccaaaaatgaaaatgcctttcactttcacaagccagtaagtaaataatgtggtgtaaattgcggatcttgaaatacaatttcaaagtcaagaaaaaaaaagaattttatgctacaatttgttgataatgatttgcaaacgcatttctaaagtgatataaagggcgttgataattttagctattcaacgttagatcttttagttattctacattgttcacatttcttgaaactctattgttctataaatttggcatattaacaaaggataatcaagacaggtttaagaccagtttttatcatgtgcatcagattcgcaggcttttgatattatggcccagtaacataagtgatataattttttctcctacacacattttagaagaaagagagacatgaaacaatatataggactgccttggaatattgtgtgtttggttccagactgctgcaataaagtaaatatcacaataaaatgaggcacacgaatatttttggttccccagtgcattaaatgttatgtttacactctactatcatctgtcaagtgtgcaatagcattgtatctaaaaaatgtacataccttaatttgaaaatacattactcctaaaaaaaatggtaacaatcatctgagcctgcagggagtcataatctttttgctggtacaggctcttgcctcagtgaggatggctgctgattgatcagggtggcggttgctgaaggtcgggatggctgtagcaatttcttaaaataagacaacaacgaagtttgctgcatcgattggctctcctttatagccaatgatttctttgtagcatgtgatgctgtttgatagcattttactcagtagaacttctttcaaaatttgagtcaatcttctcaaaccctgatgctaatttatcaactaagtttatggaatattctaaatcctttgttgtcatttcaacaatgttcacagcatcatcaccaagagtagagtgcatctcatgaaaccacaatctttgctcatccataagcagcaactctggatccgctgaagttttaccttgagattacagctattcagtcacaccttctgactccacttctcattctggttctcatgctatttctaccacatctgcagtgacttcttctactgaagtcttggaccctcaaagtcattgatgagtgttggaattaactacttccaaactcctgataatgttgatattttgacctcctcccctcaatcatgaattttcttcatggcatctggaatggtgaggactttccgttttcagtttactttatccagatccatcagtggactcaccacaatatagcagctatacctttatgaaatgtatgatttaagtaataagacttgaaagttgaagtgacttcttgatccaaggactgcagaatggatgttgtgttagcaggtatgaaaataaaatcattctctttggacatattcctcagggctcttgggtgaccagggacattgtcaaagagcagtaatattttgaaagacacatttttttgagaagtaggtctcaacagagggctcaaaatgttcatcaaaccatgctgtaaagagatgtgcagtcatctagtctttgttgtttgatttacagagcataggcagactagatctagcataacctgaagggccctaggatttttggaatggtaaacgagcactggcttcaactgaaagtcaccagttgcattagcccctcacaagacagtcagcctgtcctttgaacttttgaagccaggcattgacttctctctagctatgaaagtcctagatggcatccttttccaatagaaggctgtttcgtctatattgaaaatgtgttgtttagtattgccacctttattaacttagatgttagtttgatcttctggatagtttgctgcagcttctccatcagcacttgttgctctgccttgcacttttatgttatagagagggcttattcattaaggctcatgaacatacttctgctagcttccaacttttctgctgcagcttcctcacctctctcggcattcacagaattgcagagaattagtcctttgctttagattagccttttgcttaagataatggtgtggctgttttgatcctctatccagaccactaagacattctccatattaaaaataaggccgttccactttcttattcctgtgttcaacagagtagcacttttaattttcttcaagaacgtttcctttgcattcacaacttggccaactggcacaagaggtctggctttcagcctgtcttggcttttgacatgccttcctcaccaatcttaatcatttctgacttttgatttaaagtgacaaacatgtgactcttttttttcccatgaacacttagaggacattgtagggttactgactggcataatttcaatattgttgtgtctcagggaatagggaggcccaaggagaggaagagagatgagggaatggctgatcagtggagtagccagaacacacaaaacattgattgattaagtttgccatcttatgaaaataagtaatgggaaaaggactctgtatttaagacatgatgctgggatggctggttagccatatgcagaagaatgcaactggaccccctccttacaccatatacaaaaattaactcaagatggaataaaggtttaaacattagatctcaaattataagaatcctataagaaagcctaggaaacaccactctggacatcagacttgggaaagaatttataactaagtcctcaaaagcaattataacaaaaccaaaaattgacaagtggaacttaattaaactaaagagctcttcacagtgaaagaatttatcaacagagtaaacagacagtctacagaataagagaatatatttgcaaactatgcatctgacaaaggtctaatattcagaatctatagggaacttaaacaattcaacaagtcaaaaacaaataaccccatcaaaaaaaatgggcaaaagacataaacagacactactcaaaagaagacatacaagtggccaacaaacatgaaaaaatgctccacatcactcaacatcagagaaatgcaaatcaaaaccacaacgagataccgtctcacaccattcatactggctattattaaaaagtcaaaaaaatgacagatgctgctgacgctgtagagaagagggaactctgatacactgttgctgggaatgcaaattagttcagccacagtgaaacagtttgaagatttctcaaaggacttaaaacacaactatcgttcaacctagtgatcccattactgggcatatagcccaaataaaacaaattgctttactaaaaaaccacatgtattctcatcctcatttcagcactattcacaatagcaaaggtatgaagtcagcctaggtgcccatcagtggcagactggagaaagaaaatacggtgcatatacaccatggaatactatgcagccataaaaaagaacaaaatcatgtcctttgcagcaacatggatgcagctggaggccattattctaagtgaattaatgcagaaacacaataccaaataccacgtgttctcatgtggagctaaacagtgcgttgtcatggacataatgatggcaacaatagaaacggaggactactagagtggggagggagggaaacaagggttgaaaaactaactatcggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgacctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatcacagatcataacaaatataataataataataatgtttgaaatattgagcaaattaccaaaacgtgacacagagacgtaaagcgagcacatgctgttggaaaaattgtgcccgacggacttgctcaatgcagccttgccacaaactttcaatttacaaaaagtgaaatatctgcaaagtgcaataaagtgaaacccaataaaacgagatacgcatgtacatatttggggattattactcctcaattttttcagtattaatttcttgttctaccttgaataacatcattttggaatccttcgaacttccacttatcaagacgaattctcttgtccctattcagaggaatctatacagcaaattgaatcataagtgtactaaaataccaaagcagaagataaattacaagacatgaatagtgaaatgtaactatttgagggcattatttgtaatagtttgcctggtacatactcctcctaattttgcatcctaaagatactatccaaagactgtagaaattccagatacaagaggctagagttgacaggtaattaagctttggtcaatcaaagagctagaaaatatttattgaaataattgtatgcataacacatcacagtagggaatgtgcctcatggatgacatgaaagagactctctagtgaaataattgaacttgtgatgaactttcaatgcagttggggaggtgaccttcaggccagcccatgcatgctcgcacacgcagttacccaataatagaagacaatatgtaaatgacaaacgtaatagtctacagaccacatatcctaccctaatgggattctgagagatgggattttatatgggaccaggttcagggaaggtgccatagaggaacagcaacatgaactgtaacttagaggatgaactcaattaataatgacctaatgggagaaggaatttcaggacaaggagtagctttaaaactaaagtgtagaagtcagaatacagcagagtggttgagaaagagtgggaagggcagctgtgtaattagttagcagaattacgatggctgtgatcaagttgagaagggaagctggggccagaatgtgagggctcagaacactagatgcccaaataaggacatcatgttgaaggccatgggaaatcatcagaggtttgagagcagaagaatgccacaataaaagtggcatgttagaaatattaacctcgtacaactgcatccaatgtcccttccaagaaagaaatggaaaattaaattgcagtaacccaagaaaagcctcttgtatctcctctttgattaaatgtcctgtcatgaaaacatgtaaaacatttctaatttaccttcatgcatctttttaagaagaatataataactccactgcacacaaggaacataaattcaaccccattgcttgtaaaaactgtcccaaagaattattaaacaaatttgctgattctacttgtaatattatattttactatataggggtaaaaagggattgtagtttcagtttagaaaaaaggtaaacattcagaatgttttgttaaattcttacattcctactctaaaggataaacagagactttcagagtgtgagaagaaattgagatctctctggaaatacaacttcaaggattattatcagtgataagaagtattaacatatgttatgatgtcacattttgtgaatataacttttcaatgcccttaatacgtattgctgcactagacctgatatttttctttgggaaataagtcttcaggtagtactcctatttctaggaaaggagtactggggtattgtgctcatctgttcaaaaataaaagtcaaagctaacaaaacatttgttaaaaatgcattcaaccttttcacgttttaaaaacattttgaagatattattcatttaagtactgaaacaaaaccatgctttttatttctaacggcagccatcaataaactgaggcaaagcaagagatgttaccattcgctgatactacctgtagatgggaagtgaagtgaagaaatgagtgattatctagaggcgattacactcatgaacacagttaatcagaataattcaagccccctaaccctcttctgctgtcttcacatggtagatgtgaaatttgaattatcaaaataattggcacagctgttcaattcatgtttcccatatagggatagaatcaggctcagtttattcagctataaagtggagataattacattcatataaaccactcttgtgtgattaaagcaatgaatctatttataagaattcaaataccttaggtagaaattagtcaaatatggctagtccaggtttctttacagtaacagcaattaagacatatgttatatagaatatatttaatccatgaggtttcagccttctgattttgccaaattctgagtgctacaaagtgaagatacatatggatggtgaacaaccatgtgttcaccttaaacaatgctatattaatggcttggaaatccttgtgagttttacaaataagtgtgaaacaggagtgcatgtgtgtatgtgtgcatgtgtctgtgagcactcacacagacaacatccgaatggagaagagaggtatgaataaatatatatcctaaatttgcatcaaaatggtgtaatggttacctttggacgtacatataaggggaaaaagtgcttaacaactaggtctcattcttcaaaataaacaacatcctttgtacattttctcagcagttgtctgggagatcaacattaatctatttcttctcagaacttatatgactgggaaaaagataaaaatctgcccttgattgggtgctatgtgtttaagctctggtttagctgtaaatcatttgtgaagatcatttcttggtaggtgagtggaattgctattatagagtgttaatatacttgcagtgaagtgttgctgggggtaggaggtgttagacattgatcaggagcttaagagatgagctatttatttttgctgttgtaagagcaaatttctataataaaacaatgattctgcttctctgtcaaaaaacaccattttatgacatgaaagctctcttcagtaaacaaagaacagactgttattggagaacgtaaaaattacaatagaatatatttccctataggagcacagtggcctttaactcagctggaacttacagtatgacagcttttaaaggaagggacatattctatggggaggattttagacatacttgtctattccctaggccgtactaattcttatcatataaaaatgggtctacattagcacatggtgccagtatatcacacacttgcactgcggcatgaaaggagcccagcttgagggggagaactgctttctgtggcatagttccaagcaaacacatggcacaaatgaagccgattctgaggaatatggaaactttatgtactgtttgatagggaaatgtgcacagcttctaaacggtgagcttctagttctgctccaagaacaagtacaatcaattcttaagtggtttctgtaatgttgtgttcctaaccgagctgtttacattatagggaagtgttaagtttaattttctgttttattaggcaggtttctcattatgaacaataatttcaataccttttaagtaatttaaaaataagcagtaatccctgcagaaaggctgcagtaccatttctctagtgattcctttttctgtgttttatttgtataaggtgagcaaaattgcttattctttgttgcctcagagactttagtggcatgaggctaggcagagacaaaaactgataatcataaataaatcaacactattgggtggttccaatatccagtatctcaatgttctctgccctttgtctctttctgctatattaatgatctgtcttaattttacaagttttctgtaagatagtagacagaataggtgttactgaggtgaaggcttcaatccaaactacaaaactaggtagcctagaggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagccagttaggatcaggatagcatttgtttgtttctttttttaattattttgagattttattattattattattattatactttaagttttagggtacatgtgcacaatgtgcaggttagttacatatgtatacatgtgccatgctggcacgctgcacccactaacccgtcatctagcattaggtatatctcccaatgccatccctcccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtaaatagtgcctcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttttggatggggttgtttgtttttttcttgtaaatttgttggagttcattgtagattctggatattagctctttgtcagataagcaggttgcgaaaattttctcccatgttgtaggttgcctgttcactctgatggtagtttcttttgctgtgcagaagctctttagtttagttagatcccatttgtcaattttggcttttgttgcccttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagtggtagatatgcggcgttacttctgagggctctgttctgttccattgatctatatgtctgttttggtaccagtaccatgctgttttggttactgtagccttgtactatagaagcattccctttgaaaactggcacaagacagggatgccctctctcaccactcctattcaacatagtgttggaagttctggccagggcaatcaggcaggagaaggaaataaagggtattcaattaggagaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacgacagacaaacagagagccaaatcatgagtgaactcccattcacaattgcttcaaagagaataaaatacctaggaatccaacttacaagcgatgtgaaggacctcttcaaggagaactacaaaccactgctcaaggaaataaaagaggacacaaacaaatggaagaacattccgtgctcatgggtaggaagaatcaatatcgtgtaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactaaaggatagcatttgaactcaggtctttctgactcctaagtctagccctgtccacatgtcataaggtctcttcccaagcaactctgcttcctattctaacacttattccttactttcctgcctctgtgactctggttctcatgccaccaaatccatcaacacttccttgcagtcctgtttctaaaatagaattcagtgggttaaacaaatcatgattttaaaaagcagaagggaaaactacacaattggcttgcttctcctcatctttctctaacttcatttccagctggacacttttccctttttgttctgctttattattatttcacacaaatacattcagatttgtcaccttttgttctaatgctggaaatacaaattcatatggctaaaacggagtggaccatgacattgcccccagaccccacttttattccttgtaattaagaaaaaataaaccttaataagaagcttgtattaaaattgtgcaaagttagtcattactaaatgttcatggctgtattagctgcctgtggctgttgtaacaaatgattacagacttaatggcttaaaacaacccaaatttattatcttacaattttggaggtccaaagtccaaaaaatgggtctcacaagctagaaacaatgtgttggcagagcttgcattccctctaagggatgtaggggaggattcttttccatgccttttccagcttttagagcctgcctgcatttcttggctcttggccctgtccttcatcttcaatgccagtagtgtagcatcttccaatctctcttttactctgcttgtatcatcacctccttctctcttaggaggactcttgtgattacattgggcgcactggggtaacccaggctatctctccgtgtcaagatttttaacttaaccacatctgttaatacaaagccttttgccatgtaaggtaacatattcacaggttcctgggattaggatatggacatctttggcgggggaggagtgggcattattaaacctttcacaatggttctgcatttacttagcatgagaagctgtttgtcacaatgtgacatactgacatacttcttcgggtgggttcggtactatgtgtcatcgacaagagttacagtatctcacaatctagaaagcacaggaggcaaaaaagcaaacaaaaaacaaccagtcataccaggctcctgtgtccttgtggcagacatggtttaaccaaaggcctccggaagtgggaaaggtgtattgttgggtctctttcaccctgtaaccaaaagaccatttgaattgaggtggaaactggagttcacaaaagcgttacattaaaaaaataataataaactgtgactccctgaggaaatcacagtgtttctgtttggtgacaagctgctcttcaggaatgaatcctataagaatttcagataaagctcttatcttttggggagtgaaggctgcaggaaaggctagggtattgccttctgggatgcagaaaaaccatcttccccttagctcagctttgttcattcaacttagttcttcccctccacacccactcataaacattaagccttcttcccagctgtcttcctctctctttttcatttttaaacttcatctactttttgaattcttttctctgcaacaactactactaaaatctgaaagcttcttctattgttaccatggagagggcaattttctcaacaagtaaaggaggtggtgcagagggagagggaagaactacatatgaaaattgaaagttagcctctgtgtcttttcaacaacatcaaattaaatcttttcacttccatacacaaaacaacaggaacacacagtgggtggcaaattcagcccagggatgtgaatgaatcagtaggctttgtgataatatgctgggggtgtgagggaggtggcgaggcagcccctcaatcctaaaacagaaaagtaatgaacaatgataactgatatagacaattactctgcagttgtttgaatatatgctgctttctatcattttcaggtaaatgaccttcagaatggcagtagatggatttctaagaaatcatgaaatacaaacatgtagacaaacaaagcaggcagaaggaagtaataagtttaaaaaatgaagtgctataagaactgagagagaaagattatcaatcctccctttttctttcttctattcttctctatacaagttatgaagtggaagaaaatacaaatataaaatcatctgatggtgaaacatcagtgagattttaattatatctagattttttaaatctcaaactaggaaaaatctgctgattcacaaacatgaaaatattttaaaagatcagagatatattaattctcatgttctaattctcctgacatgaaccatatatatgctttattctttctgatgattctgagaaaaatcaaattctgaatttttaaaatgatgatgttgcccaaattgtaataaatcaccatattttccaaagaaaaattctacacaattcctgtacataaattttgtgtggaaaggcttgtatcataagaataatcaaaggaaaagaactgcaaactagtagaagcataaatttaaaatgttgctgatgatgacatcgagtaaagatttgaagtgttaagtagcatgttaaccaactttttctatgatcctcttccccttctcaatacccactctagcttttaaaaacacaatgagattgttttctacagcacaatgatgaacatttcaggtgtataaaaaatataaagaaaagattacaagtgaagtctatggcatggctgtactaatccacacacacgtacgctcggcagtgtaaaagttacctcactgatttgcttgaattaacaatttaaaataaaattttatactgaattaatgtttatttttataaaatagcagtgttattagaaagatttctgacaagtagtgtacgattacaaatatcatctaccttggagttaccatgaaattaggagggtaaaaatagtaaataaagatcctattctagacatctggcctatatgcagacaaccaggcagcacaaactcaagagtccgcttgtaattgcttttgaattcagagaaaattaatggtaagttggttggtttacaacacacaattctcttatttgcaaagcaaaactgaaaaatacagatagatagccaggcagggaaaaagagagagagacagactgactcattaaaagagagagagagagacactgactctgatttataggatacttgcttatctattcctgttagaattttctgcttgccacttcacatagtatcaacaaaacgaatgtattacccccaaattacagactattaaataaagataaaaactaagatgattttcatgagaagtaaacaataagctttttacacagcacaaactgaggatttcattacacaaagttatgggaaaagctacatattgatatctttgttattgtgaatatctcagttattgtgaatctgtaaattccatgccctattacccccatacaagccagggagatgtactcgtataatagcatttcactcatgattgaattgacaccaaatggttgcctctttgcaatatatacaaagaaatttttagttgtgggctttgtgttttgttttgtagttagaccgctaaaaataatcaaatgtctgatatagttaagccataaagatgaaagaagtgtctcacttaaaatatttattaattacatatgtttttatatctataatatacttatattctgatgtgcaggaactcagttacttaagtcaggaattcacgtggggatagagttagaatttaatcagaaaggccagtctcctggggtgggttctaccagcatttgaactattttttatcacagtcaacactagaggccttgctaatgagcaaaatgaatattagaaatgagttttcacttatgagattagtgttacttaagatacatgctttggttaaaatatttgagagcaattcctcatctctagcttgctaggtataaaaatatagtaagttatggaacctgtattctttggaatggtgcccaagatttaatgcctaaactatgctttgtttccacattgaatccgaagattctagttgtctgatgccttctctaaggttaactgcatcctgcctctagattctggaatattctcatgtctcccttgattgaaccttttatacggagtatgacaacacctgagagtgagggtatgggagtgtagctaacctttacctattatactaaagttttgctgtggttatctaccaaaaataacctaatagttggccttgcataatagtgttgatctagggcaattcataacaccacgtaagccacaaattttaaaataacctccactataaggaagtgtaaccaactccttacattcaacaatacatttgactttattcttggagtatattattacatttttctttttatttcctcatggttatatttgttataaagcatggttttataactaggtcgttaaagatctttaaagattgtgttattttttgcatactattactatcatatgaataatttcacaatcttgccttgtctttcatcttgaggcacctattcacataattattttttcacagtccaaacaataaccaggccttgtaatttagttatgaaataaaaaggctggtatttacataatcgtcttatgagttatgcatgtgcaagaaatgttctgcatgtttgtgtgcgtgagagagacacagagagagagcgagagattgagagtaagcccgatcattattgaggggtgtaagaaattactttatggagatgcaaaaacctggggttcagatacgagactgcggtgagatcattgcctcccaccctctgggggctcatctgagctgccaaaatattctcctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttggtcaaagccaaacactgtatgtttaaataatgatggttgggcaacaatgctatgtctttaagcatttctttccatttttcaaaatctgctctttcttattcacaattatttctactatttaatattttaatgggaagagttggataaacctaaatgtgcagcattgggattcttttcatagtgatcacttaaagtttgttttgctttttttttttaccttatatcaagaaataatatataaccaatacataattatatgaaaacatcgatctttaaaatagcataaataacatcaacaatccttccctatgtgtatataaaatattcatagatatatatgtggtgtgtgtttctaaaagtaatatatgtgtgtttgggtatataataaatattgcaacaaaaacaatatcatgtagtacatactggtttgaaggtgctctcctcactatactccaatttacacaccacaatctatttcagcatcccactaaattttgggcaatttaattttttcctgctagtccctatttgaaataatgagcttatctgtagtgaaaagctgtaaatatgctgcctagattcccctttggaaatgaaggacttagttccccagctgctaggagtgctgctggtagacagccttcagctgtcagcccttgtcttagtctgggccgctatagctaaataccttagactgggtaatttataaacaacagaatttattgcttatagttctggaggctgggaattccaagatcaagacatcagcagattcattgtctggtgagggcccactcctgttaaatggcatcttcggtgtgtccttacatggtgggagggcaaggaagctttctggagccgcttttataagggcactgatcctgtttctgaaggcagagcccgcatgacctaatcacccccccaaacccccaccttctaataccatcaccttgagtgttaggtttcaacatacacattttggagggacaaaaacattcagaccatagcagcccccttatggaaattcccgtggctaaagagaatcatcttgctaaagttcgttgccttcctggagtagcccacatccagtgcatgacttgacacggggttataaagatccagtcccctttcttcgtttcctagcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgtttctctctctctctctctttttaaatttgtaccatcaattggaaaggggctttgagacactatactaccattgcccttttgattccctctcaaatttgaaagctttatttatgatgcaaaaatagccatcatgattaattggttttttcaagtgtctatcatttttcaccaaggataactgctatgattagcaagaagaacctccatacaaatctatttaatcatctaaaattcatatttgttttaaggatgactgttattttgactgataacgtaaaatactactatgatttcagcgcaaagttaaagtgtgaagaaaagtaatacagaggttggcataaccatcaaagggaatttcttaaagaatatagaacaaattcaactacagagtagagatttattatttactaagatcttaaaacatgctttttaaattctgataacgaaaatatgacatagagtttgctatcctagttttacagttgaacaaactgtaatagaatagatcctaaaatttgtgcaggttgtcaataacatacagggcaaggttttagatgcctgactttaaacaaagctcatgctatttctacaaatacaagaaaaccagaaaaaaatattcacatagtcttaaagcttctctatatttcaggagggggtgaagtaactgaattatattaacagtgttctttaccatgatacccaattcttgtcatgaataaaaggtgatgttcagagatgtcatcaaataattgacaaaaaaaaaaaaaaggataagaaaaaaggaatgaaataaggtagtgaccaaaccttccctttttatcagtgatcaaaatccttgcttttacatatttataaaatccattctatttctctggatgtgtaatgaaagaaaatgaatatgtatgttcatttctaatccatttgaaataacaaaagagatggcattctgagtccacattctctttccagattttaagttttataattacttacgtaacactatcaacgaataggacaatagaatacaaacaaaaagtgaatcctttttagaagacagtttgagtacaaactgctatatattatgtactactctttaaagctctcatgcagattttaataattaatcaatattctaaatataaattactatatgtaaagcagtaatctatttttataaataaaatgatttcgtagaatgctgtgttaaattctttccctcagacagttgctctagagaaggaatggctgcttggaccctggtaggtacatcatggtgagaggcacaaatgttatcctggtaacaacttcacaaattatagacatagtgcgaagagaaaagatttctaaaagattaatttggtaaaagcatatgtagagaaatcaagtgactcagagggacatacacatccaactaagataatgttctctcagctgtgctcctcaagatgctctacacaaatggtttccatggagaaatcactgagaaatactgagctaacaatactaacattcctaaaagacttttcagtgaccttactatggagatgtacatcatagattgctaggataggcaacgtctatgcatgtttttcagcttatttgaccttttcatgaggatcatgtatgaacacctgatgaacctggttttctgtaggacaattttggaaatgttgagatcttttatcaactagaaatgatagtatatttcctagtcaaaatattttttaaccactttattgatttcttaaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaatagactacgaatggccatgtaaatattggggtttgtgacaaaagataggaaagcctatctcaagaaggaaaaaaaagtgttacaagaaaggcaacattggtaaggaagaaaaacttgatctttaaaacatgttattctaaacagactatattacttgttttcttgtttgattatcattgctagaactggtaatgtttttattgctcagtgtatactttctcttgaactcagtgggtttatttgggtcttaataattcagaatataaaaactgatgacctaataccacgtatattgatgctaacggacatgtttagaatttgtcagactatgtaagctattatgaaagttactgctttctctttctccaacataaaaatattcagaggcagaaagatagacatgaataatagagttttttctccattttatttccttgatttctgaaacaaatttaaacagaactaagaagacaggaaaacaatcacatcatatttagctaagttaaaactgcttatgtccaaagaagaaaaatgtgcattattaagagtatcttggctagcatagccagctgcctatccgataccctttctttccttcttagctaaaaaaatccaaattctgttcagactagcaaggttttataactaagttaccaattttcacattttgaattatgaagaaagaaacacacctattcagttaaaacactcaatcctcccaagatccttagaagttaggaatggtcacgtgacacatttctggttaatgcactgttcaagtagaaactcttctgtgtggggctgccagaaaagcactggttttccttacaaacaggagctgacacagctggaatatgcttttactttccccattttcccttcttccattttaaagtacagacatagtgcctggaggcagagtagccatgttgagaccacaggaaaaaaagtcttgctgggcacggtggctcacgcctgtaatcccaccactttgggaggctgaggcaggcagatcatgaggtcaggagatcgagaccatcctggccaacatggtgaaaccccgtctctactaaaaatacaaaaattagctgggcgtggtggtgcgttcccgtaatcccagctactcaggaggctgaggcaggagaatcccttgaaccagggagtcagaggttgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacaggaaatttaaatttatttcgaggaccagaaaataacaatctaaaaagtcaaatgacaacatacatttgaaaagaaaagttcaagacaacagaagcagctttacaagaaaatatatagttaaaggacaaaatgattttggactgaatcattgatgaaaaagaccaatacatattggcagccgggcacggtggctcacgcctgtaatccccgcactttgggaggccaaggcaggtggatcatgaggtcaggtatttgagaccagcctggccaccatagtgaaaccccatctctactaaaaataaaaaaaattagccgggtgtggtggtgagtgcctgtaatcccagctactcaggaggctgaagcaggagaatcgcttgaacctaggtggcggaggttgcagtgagccgagatcgtgccactgcactccagcccgggcaacagtgcgagactccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattatatatagcttcttgcctgcttgcattctttccaactactgatctttgcccccagtaaatgtcctcttctagtgcctaacatctattacataacttaaaaaaatcaaacttgagtaagtgtggtaaagtggcaggctaatttttatgtagaatttctcagaggggacttctgattctatctgtggaagcatttcattactttcgtataatataacatgacagaaagcttagcctcaatgaagttgctacaggttattttccctctcactacaatctacttctttcacatttagggaaaaaatatgggattaagagtaaattactctctccaaattactctctcctctccactttcttaagtatagaatcaactcaatttatctatatgcttttggcaaaaatcgtcttcatggatttaattttttttaatttctagtttgagtgttcaaaaataattctggagttgaacatagattaacttgatatgggggaggggttacattggtcattacagtttattttgcttccataattgaagagagaagatgacagttaaatcaaagcatttctgttcttgaaataaataatacagtatatattcttttcttgaataaatcataggagatatataattcttaaatattatgtcacttgtttacacagaatataaaatataaaggtaagggaactgaaagcatttgtgaattactaaaattgtattcaaagttatttttataaatcgaataagaaattgactcaaatcattttagaaaccgtggcattatttttaatgaattctttaaaaatcataaaagcacaatcaaatcctgttgctttttttttttcaaaaacaatgcagccattactaccttggaaattactgatcaattcatttatgaaatttaaaaacattaaaacatatgcaaaaatcaactttcactcccaagttattgaataaaaatcaacaagatccctggaaagataaacatagcttaattttcatctatatgaaaaaggcaggcacatatttagaataagaaatcacaattgatcagttgatttattcattctaatacatatatgattgaaaccaccataacacttttttcttttgtggccatgactgccctatcttttatgtttttcttatagaggatacactctaaaattagggcctatccctttttaatttttgttccctaagagcagataacactgatgcctttcaccagcaagtgttcaataaataacagatgaatgtaaactcagtattgtatcaaaagctcttaaaagacagtcaatatatttctaaagaatctttatgacactgtaactcgaggtatcaaaagtaagcacttgaaggaggaaagaaaatactagtagtatttaattacagactattaaaatatctacttaatgtatacgttaattttatataatatgtatcactttaacataagtaaccatatacataaaagtgtggatacaggtacagaaacacttttactaatagtgatgtgtgatcactgcctcatcttattcacacttattcactatcatacacaaggaaatcaaatttaaatccaaattattactctagtgtctctttctattctcctttcttaatagtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgcccggctaattttgtatttttagtagagacggggtttctccatgttggtcaggctggtctcaaactcctgacctcaggtgatacacccgcctcagcctcccaaagtgctgggattacaggcgtgagctaccatgcccggcccagaattctctatttaaacacaatggcaaacataaacttccttatcagaatcccactggtattttatggaaaacacagtacagtgacttccatcagaattcatgtaaatatcctggatcagttttgcttgataagattttgacagaaaagtttacagtgaattgaattaaaatataataagatacacatttccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattaggtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatttgatgcccatggaaataaaccatgtttgctttgttttgttataatttggatggagaaatgagatgtgtaagaagttgaggggggtggctgaggaaatagaaaagaagtaagaaacattatctattcccaagaggtctgggggtctgggtttatgttaggacaattacatttactaagtgactttagatcaattaactaaattgtctataacttctctcatttgttgaataagggaaactattgtaatagccactttctgctgggtttgtgacaacagaataaaaccaagaaacattctgttttgtattgcttttagtttaaatagccaatgccactttacccacacattgtcccatcaattcttccagggctatactacacaagttgtttagtaatcagattttgactgaatctattcaccaaaagttataatcagaattattctgtagctaattcaaatgctttttgtgtatagacagagttttaaaaaatcataatttttaagtactttgaccttaacaacaacaacaaaaattaaactcattcaagtaattatgtcccatttaaatatacactatacccactaaaactgctcattcaatttttagataatgaaatctcccaggtaacagtgcaatgtgtggttaaaaattaatcttgaacaatgctattatcatcttgtccagattggccaatttgtctcaaccccaatctggaaaggtcttactggaggataaaatgcctttgccaactcaattctttattcaatacaagtgcagtggttgagattttgtggtgaattatcctgaacacctggccaaacggaattgaaaaaaaagactacaattaactcagcacaggcaatcagacaccagtattatgaaaaataatatcatatggccatctaaattctatttgttgatagcaacactagtctccactgctgggaacctctcttcatatttccccctccacctttctccctcctgtctcccaccatccctcttccatttcctcctttcctcactcctcttttgtcctctttaatattcctttcttgtctttttttctttccttgctacctttcttttgtcttttctctctccttcccctttttcctgctttccttcctctcttccttctttttttccctttcctcctccttccttccctttctttcctcccttctttgttctctccttcctttccttaagggtcagatttagtaatcactctcaaagcaaaacccaggacatatttttcccttcatttgatagattatgtcaaaaaagaaaactgctaattcttgtcaaatattgttgtttcagagcaattttacttatgtttatgtgatgaaacagaaaaagcattttttaatcagatttctccgacactaagctataaagtacaaatcatccactgctattgattcacaattctagaaattaaactttgaacttcatgtgtgctttacttctaaaggcttaatttgcatatttcacatctctattcttctaaaagataatggtatattttctactgtctaaaatgaagcagatttgcttaatttttttaaatggctgtattcttaaaacttaaaaaaattaaagttgtaattgtagcttccatttttttcactgaatataattcacttagtaaaaattatttttatttcaaaatggaagcagctcaccattttctaaaataatactttaatcaagcaatacatactaaaggggaccataagcttttcaccaaatatgttttctgagttcaaagtctaaagctagtgaaaggttagcttacttgaatgtcatgtccttataccccttctgtggcaaatatttcaattactgcacgtctaaggtttggtctgaatctcataactaactttgccttgagtcataaaatgtctcattgcattatcttatctatcttctggtgctttggaattataatcctcacattccagtctttgttgaatatgaagtttccttatcacattgcattcacattatccatcaagctatccacatttattgagaaccaattactgtacgtgtcatggtcaaacaaatttatatttcaggtattggtatatgaatggtctttatttcaggtctacacgttgtgaagttgagtagatgaacctgttgctttagatcagctgtatccaatcttttggcttccctgggccacactggaagaagaattgtcctgggccacacataaaatacactaacactaatgatagctgatgagcaaaaaaaagtcacaaaaagtatctcatgttttaagaaagtttacaaatttgtgttgggccacattcaaagccatcctgggacgcatgtggctcacaggccatgagttgaacaagcttgctttagatcataataattacctcctacaaatctcctttatttgctctatcctccaacttattctacatgttcttgactgagttcagtggacaattattgtttagtggttggtcagaatcatttccttcttctattgtcaatagaacccagtttctattcaggagaattgcctttccctaattttgagactttgggaggagagggatttaaatcaaagttttctgctcccttctagctcatgtattaacatgtgacccaaacaaggtgaactggactctcttttaagactttaaaatttgaacagagttacacacaggatggagaaaagagagtatcacaaacagactggaatacttcttgctagccacatgcccagaaaggcatgctcagattctttttccttttgtaagttttgttccaatgcctttgtgctaattacagcacatttactttctgcctgatttaatcagagaatgatttctgttgcttgcatccagagagctctaattgataggcaactaaactatatgtgatgattttattttcctgtttacaatcctttcagagttgccactgcctgtaggccatcatcaaaattcctcagtctggcaacaaaggattcccattatttagccccagtcctctctattcaacctcatcaatttcttcctcatcatatacccttaacttcagccatatggaatcacaattcctctgatatactctgttttttttccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttattatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttgcctaatttttcacacatcaaacattaaagttgggattgctttatttaaaactttacataaaattgatattgatttcctgaaattataacaaaatcctccccatacttacttatccttcttatttcccctctcacacacatttgtttaatgattatttagggccattttaccgacaatttggtgattgaggctataaaagccaagaactgacaatgtctttaagaattattttttaatataagaggaagaggcaggcaaagcatccccctattcagcaagcaagagaagggagattagatttttttataaatatgtaatatatgaacattacatatcattatatataatatgctatatatactattttaaaaatatttttatatataccatatataatttataaatcctgtatttttgtgtctcagaaatggcttttgatttttccccctaaatttttttttttctgagatggagtctcactctgtcactcagtctggagtgcaatggtgtgatctcagctcaatggaacctctggtccaggattcaagtgattctcctgcctcagcctccctagtagctgggattataggcatgggccaccacaccagctaatttttttattttcagtagagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctgtctgcctcacttcttgttttttcaaaaggtagtactttaatacctaaataccttcagcacaactttgtatttctttagaaaggcttgaaagctgttacaagtgaaaaaactttaatgtataacaattccaacattatttttcttaatcattcacaaatataaaagatatatagtatatttgatctagctaggtaaaccatatttacatcaatgtattctaatgtttctagttgatgtcataattttaccaaatggattacactgaggctgaaaaatgcactatttgtattaaaaacatgttcatttgaacatggcattgcataaatgccaactttaagatctagggtaattttaaatatcttatgttttgttacttttctctttttaagttatagctctctttcaattatccttatcattggagaaggcaaattggcacagacaacttagaagagtggataataatcaattcccagactattatatttgattctgcaatatgttgggctgcgtagtgccaaaacaaacagtttaaatgtaaatagctcagttgagtgacttatttggtataaaatagatttttaaaataccaggttgtttagtaaatttaactgagacaactattcttgtaaggtttctgcttttttttttttttttttttgtatatttcctttttaatgtatggctacttttgttatttgcattaatttatatccttgattatacttaggctgaatagtgagagtaatgtgtttgctgagagagaaacagttgcctaagaactggtgggaaatggtctaggagagtaaagtgattggtggaaaatcttcattttaaagaaaaacttctgccaacttttatcattttttctcataccttctgcttgatgatcatctcgttgatatcctcaaggtcacccaccatcaccctctgtgattttataacttgatcaagcagagaaagccagtcggtaagttctgtccaagcccggttgaaatctgccagagcaggtacctccaacatcaaggaagatggcatttctagtttggagatggcagtttccttagtaaccacaggttgtgtcaccagagtaacagtctgagtaggagctaaaatattttgggtttttgcaaaaaggaaaaaagaagaaaaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacgattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagcagtttatcatatttttttctttttatttcagattgttagtaaactggccagcagtgaagaaaaaccaagatacaatattttcttaaaaatgcgagttagtagtttttctatttagacatgaaatactgtttcaaagtcattaaataaatcttaatatgaatagtgttggacactgtagagtaagtcagcctatggtaatggttaagatgcatagtactagaattaaaatgtctggtagacaatcctgttctctgccctaggaactctgggaccttggtaaagccacataacctctctaagtttcagttctaacatttgttcagtactagcaataagcagtaagcaaggcaaagtgggaagcatttttcatgtatttaccttaaaagaggaataataacagggtaaatgtcataagggcagttgtgtagattcagtgagtagtacaagcaatacacgtatgacaatgccagaaagagcagcataatcatcatcatcacaataatattattacagcgcctgacactatagtaggtgatcaatagtgttaggtattactgtttttataaacgcctggctagtaagaaacacagtgatgaacaactgtggtgagaaactggagataaggccccaaaatgtgaaatacttggggagtagtcagtcaaaagtccgtgtgtggccctatattgattgaagagggctgaacttgctggtgtgaattgatactaaataccaacacacagctgggttatcagaggtgagtggtgaggggaaggaatgcctaatcaagtttatagacaacagactcaagagcataatataaccagaagattggtggcaaaattattggactatgtagtttggaatgaaaggtttcaaggaaagctgcaaaagacatctcaacaggagactcacactggacaaccagtgaacgattctaagaatattaaaaaaaaatgagacattgaattttcattctgaggtagccaatcattaatttttatggctatgtaactgtgcttttaaggttgtctcctcattagagaagaagatgagtagaatggaagaatgtttcttgtctctcaagcttctcagggacaccaagagttttctatgaatgaaggaactaattttgatcaatgcagacagaaaaaaatagtgttttaattgtcagagagaataaaaaaatttgtgtcacgaaacaatgattgaaaggcagtaacagtgaggcaataaagaaaaagttttgtttctcaaagctatctgactactctgaggctctttctagaaagaattaaatgtaatgtaaagaagaaatagcattttgtgtcacagtccaggagaagaaatcatggaagcaaaaagatctagaaatcttaaaagggattccaggaaaggagctaaatatccagagaggatgcatgtgtgaggatgaaaagagagctaaattaaaatatcactgtaggaactaactgcagaacaccaggctgactggcaaatgtggatggagtgttcctaaaatagatacacaaggtatactgaggcaatatacagcaatttaggaggatttcaagcttatgggaagtgtcagaaaatgcttttttaaaaagtgacttattgaaaatttgaccctcaaataagagcagagacaagagattttttttttttctccagacttacttctgaccatgaaagaagtacctaatgaggtggaaatgatcatgtcacactaaatttcaataaagtgaaggatgaggaactagagaattatcagacttcaacaagcagaccactgtttcctgaaaagcacgtttggaaaaagacagaaaggaagaaggaaagaagaaagtcagggagggagggagggaggaaggagggagggagggagggagggaatctattgaaaagcaaggcaagacaaggcaggaaggcaggaaggaaggaagtcaggaagccaggcagtaagggaaggaaggaggaaggaatctattggaagtctattgaaaagcaaggccagggcctgagactcaaaaagagagaatggttcatgatgactaaatatgccattgggatgataaattagctgaagcatattcagaggatgatggagaggtctagcaatgcggccatccctgcgccagtcatgggcagataatctcatctatagacccgtcaggccagtatttctggtcttctcttctccagcatgcaccacctgaagaacatctatctgtacactgctgggaaagggaggggaaaccttatcagactttctcactgctctatctcttgcatcttgcacatgtcctggagtataggaggtgctcaattgattccctttgaatctaaagaaaagtcaatgtgcagtaagctctttagtgaacttagaggtcttctacatacaatgagtactaaaatttaacagccacccattagaatggaagaatggaggctagaacacaaaacatgcctaggtttttactagttaggtgattttagctattttcacgagaagataatggaggaagacccactgcttggagcagacaatgaaagatcaaatattaaagagagaaaatacagccagtcaatttatttgcccccaaccccacacacatacattttttttcctatcgaagggagaaaagcaggaaatagctctgaatcagaaagcagggtgtagaatatttaggctttctaggaccagattgttgtatttgaatccttgctctataattttttttttttttagctgtgtaactatagtcagatgacttaacctctctgaatctccatttactcctctgtaaagtggcgattataatagtacttccttcatagacaactggccttactttttcctaaatagacaatcttggaaaagtaatgttcactgacattggaggcatcttgaggtaaggaattatactatgcctgctacaatgaacatcttgaccctcaaaagttttcacctgtgtaactatgaaaacagtaccaatctaatggaattgtgttacggattttatgacatcatacatgtaagtcacctcctaggattgttctgactgtaagtacactatgtggatttttttcttcctctttttcctgcatttctcacacaatggttattggctcctcatgttctacattcgtatgggattttatgctctgtactctgaaccagatttgaccctccagacttacctctctccattctttccaggctcctccacacccatgtctattgtgcattctctcatgagcacaggccatttcaaacctgtgtcctttcatacgctttctatacttcttgaaaactttttctctcctgtttccagacaaaaatctcattttctctttaaatgtcaactctagatttctgtgttttggggaggaccagaataagaagtgtgtaactaaaatatctccatgaggaacagaattacacctttcttgtgggtcctaaacactttttagtctttaacgttttcttacttaaatctagttatcactaggaaggacaaaatcttgcaccactattaggttttggaggattttgaaagtgtctagaggatagctgatagtagttgagagttggattctaaagtcagaaactttgggtctcaaggaatatactttaaaacataaagaagcaagaggctaatcttcatcgacctctcacattagagccatttctgttcagaaaaacattacttaaaatattttatgttttctaaaaagacttgcctctggattcaggcatgtatatatttttttcattttttaatcaaagtgtttcaaaggacagaagttttgaagtcctgaaattttttttttttttttttttttttgagacagagtgttgctctgttgccaggctggagtgcagtggcgtgatctcagctcactgcaatctctgcctcgcgggttcaagcgattcccctgcctcagcctcctgagtatctgggactacaggcatttgccaccatgcccaactaattttttgtactttagtggagacggggtttcaccatgttggccaggatggtctcgatctcctgacctcgtgatctgcctgcctcggcctcccaaagtgctgggattacaggcatgagccaccatgcccggcctatttatcttattttattgtatatatcacattgattcttactgcactttcagatgcgtttacctttatctaacacatatgcggttctttcttttccaccatgtcatagtactagaaatatatgcaaatcacctttttcagtgaagtgtaggctggtcagatttgttagtggttttgtacagtctgagcaacctgttcacagttctaagggtcaggcagggtcgtattgttgtgccaaggatatttcctgttaagtcaatattttaaaagactgaaagaggatttgttttgctaagagtgcctgaatccataatctagaacgaacgggtaaagagttaggatatataaattattacatagaattttcaatgatgttctgggctgggtctcctgttgtcatccctaaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactctactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagctactaaatcttttaaaacacacacacaatgtgtttggcatatttcctttgaagtattcacacatggttttcctgtaattcacaggtctcctttggttgataagaaagcaagaagcacatactctatttctagctttgttgaatgaatgtgggtaactttttttgtttgcttcacttttatatttgaaaaatcactcaacttacaaaataagttattgggctcacattaacaattctatgagagaatatctaaaaagtgctgttagatattcccttcctccttatcattccatgtcaacaggagagcaatgttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaattaacctgattttaaaatgggcaaggatttaaatagacatttctccaaagaaaatatatacacagccaacaagcatctgaaaacatactcaacatcgtcaatcatcggggaaatgcaaatgaagaacgaaaaccacaatgagatattacctcacaaccatgaggatgaccacgatcataaacagaaaataacatgtgctggcaaggatgtggagaaactgaaacacttctgcattgttggtgggaatgtgaaaaggtgtagccactatggaaaaccgtatggaagttcctcaaaacataaaaatagaattatcatataatccagtcctcaaaaaataaaaatagaattatcatataatccagcaatcccatttctgggtgtacggttagtccccaacttactaaggtctaacttgtaatttttggactttacaatggtgtgaaagcgatatgcattcattaagaaaccatacttcaaattttgaattttgatcttttctagggctagtaaatatgcagtatgatactctcttctgacatattgggttgcagcatgatatttatcatgaggataaataattgatactctactatgtactgtgttgcaagatgattttgcccagatgtactgtaatctacatgttctgataacatttaaagtatgctagactaagcaatgatgtttggtagcttaggcatattaaattaatttttgacatgatattttcaacttatgatgggctgattgggatgtaatcccagtgtaaatcaatgagcatctgtatatccaaaagaattaaaaacaggatcttaaagagatatttgcacactcatattaactgcggcataattcacaatagccaaaaattgaagtaactaaaatgtccattgattgataaacggattaaaaaatgtggtataggacacaacggaatattattactcggccacaaaaaaagaaggaaatcctttcctatgctacaacatgggtgtaccttgaagacattatgctaagtgaaataagccagtcataaaatgacaaatactgcatgcttccttttatatgatgtatctaaagtagttaaactctttagagacagaaagtagagtggtcatattgccagtgctggggtacagggagcaatgggagctcttcagtgggtttggagtttcggatttgagagatgaaaacattctagagatctgttgaataacaatgtatgtatagttaacactactggtttgtacacataaaacagttaagctggcaaagtttgtattatgtgggttttgtttttcaaccacattttttaaattatactttaagttctgggatacatgtgcagaatgtacaggtttgctacgtaggtatacacgtgccatggtggtttgctgtacccatcaacccttcatctacattaggtatttctcctaacgttatccctccctctgccccccaatcccccaactggtgtgtgatgttcccctcccccatctccatgtgttctcatcgttcaactcccacttatgagtgagaacatgcggtgtttggttttctgttcctgtgttagtttgctgagaatgatggtttccagcttcatccatgtccttacaaaggacacgaacgcatccttttttatggctgcatagtattctatggtgtatatgtgccacattttctgtatccagtctattattgatggacatttgggttggttccaagtctttgctattgtaaacagtgctgcaacaaacgtacgtgtgcatgtgtctttacagtagaatgatttataatcctttgggtatatacccagtaatgggatggctgagttaaatggtatttctggttgtagatccttgaggaatcgccacacggtcttccacaatggttgaagtaattcacactcccaccaacagtgtaaaagcgttcctatttctccacatcctctccagcatctgttgtttcctgactttttaatgatcgcctttctaactgatgtgagatggtatctcattgcggttttgatttgcatttctctaatgaccagtgatgatgagctttttttcatgtgtcttttggccacataaatgtcttcttttgagaagagtctgtttatatccttcccccactttttgatggggttgtttgtttttttcttgtaaatttgattaaaccacattttattttaaaagggaattcatagaccaggtgaattgtggactttttaaaattcccttctgagttaaggagatttaaaagagatttttttgagtactataataaatatcatcctgtaaattccaatggttctgatatattaaggcccagtggaaaataatcgatttattttatgtcctcactactcctacttgcatcctcattgcaatatttgtggggtaagcagaatatgccagtgcctctctgtagtggatactgtaatgcttcatcaagatcctcttctggagtcgatgcacccacactaccaatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgtgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggtgcatggctgtaatcccagctacttgggaggctgaggcaggagaatcacttgaaactaagaggtggaggttgcagtgagctgagatcatgccattgcactccagcctgggagacaaagcaagaatcattctctaaataaataaataaaaagttaattatttattggtatcacatgttatataattcaattgaatgctctaaaaaatgacaaaaagtatgcagaggattgttggcatatttattgtttaagggcttataaagtagttttacactccttgggtatatttgagtttcaatgtatcatcagagttgctgtttcttatgtgaaatatgcacacttcctgtaactaaaagacccatgagcttgacaaattcaactgctgaagtcttgaactccgtcttcataatgaccttggaaatgtaactgctatcttaagttggtttgaagtgactgtattgaactaaacttgagttttaacgttctgggtcagtaaacatgttatgaattgcaggtatggaaaacacactaactgaaatagtggaactagctacatcaaaatcaatttatgtttttatttaacttgtagaaaaccatactatgcccagaagtgcgacaactaccaaccatacaaaagagatcaaaatcaaggggagaaaacaggtaacacttacgtaggaaaaattgcttgttagaagcacaacaaataaaaatttggtgtttgtttctttaagacatccctgccaaaccatctcaaattctttttgaacgtatgaaaggtaatcataaataaaacatggtttcagtggttttaaattatgctattgaaataacaatgttcctcagagcattagcatgacagttttgatgcacatacttcctattgtcttggacttgaatctcattgtcttaatccttttgatgaatgggtttaaaattaagagtgtaaagagtgtatggaaaagctgtgagcccacagtaaatggtttctgaagtagaaacatatccaactctgtttattcagaaagatctgtgaagctgtattattacagttgcttcattatgaacttatttttgctgcttacaaaggggaaatcccatcagatcagggctaagataattcctttttaaacaatcagtaaatcatatttaaaccttgtttacactagtactttttccatgatggcgttgttttacataaaatacatgctttcaatcttgttaaatttgttaggactcattttgtggcctaacatatgatctaccctgaagaattgtttcttgtgcacttgataagaatgtatattctcctgctgttagatgagatgtactgtatatgtctgctaggtctatttgatctaaagcataaagtccaatgcattcttattgattttttaatgtggattttctgtctattgttgaatttggggtagaagtcccctactattattgtactgtagtttgtctctttctttttatcactttatatttgctttatatatttaggtactccaatgttgggtgcatatatatttacaattgttataccttcttgatgaattgatccttttatcattatttaatgaccttctttgtgtctttttagtttttgatttttaaagcctattttgtctaatagaagtatggctatccccattctcttttggtttccatttgcatggaaaccaaaatatctttttctatctcttctatttcagtcaacatgtgtcctaaaagatgacgtgagtctcttatgggcagcatgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacgtaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatcatgctatttttttcattagtagaaaaataataatccttaaaaatgatgtttcttttttcctaagatatctagataagaactaaaagtaaaatgtatttcctctactgtaaaattacaatctatattaatccattattttaaaacaaaaagatacgaagggagaaaatttttatcaagttatgttacaaaatctctagcttattgcatgaaattaaaccacataaaagaaataataaacctaactgaaacaacattaactcctatctagggtttatcaaactacagaaaacagaaaggaaaggaattatacatcttgagaaacataactactaaatactggtggaaactatacatgtgcatagttttgaattggtaaaattcttcatttttgccctgtaaatggtggaaagaatgaaaaaagtcactaaagctctgtttcctacttttgtactaattcaaaggcatgattatgctatacttaataactatttctacttaaaaattgttaatcattgtgattttaacacctaatgtatatattttctgtggaatacaagaacgtgaacagaggcaaagagctaggtagaaagaccaatttccaaagagaaagtagggttagtttactactgggggcctcacattcccattcaatctgacgtaaaagtggaattgaagggcatatgggctgaagttatcagagactgtattgctaaaatggataatcttcccctattgacaatgggggcctgtggctaccaaaattaggtgacttgaacagataaaaccataacaagttcggatcctttcatgcatctattttcaaaaatgatattttggtgattagtgaatcagatttattattatgataaaaatgagtaagtaaattatttataaaaacgtaagctatcaaaaacttagttttcagtgccatgaaaatataggttatagtaacttgtgaagatcttcaggaaggttaatttatactgtacattctaaaccatagatgctacatctggtaatattaagttgggaagggatttatctgggaaaacaccatcatttatcaattaaaccaaggcagaaaaggttgaatagtttgcccaaaacccccaaaccatagccaacaagagatcaaatgaggactagatcccaggtttattaattcccaatccagtgatcttttaacagtgcctggtttacaatatcatgagcatgcttctgaaatattaaaaatgttacgtctctatataataactttatatctagcatgcgtagattgagaaaaatagtgacaaaatcaacttattctgaattcagtaatattgtaatataattttgcatttattaattgcagtagcatctacatcacttaaaaaatgtctactacatgtttgtgggtaatgcatcactcctttgattcacagacaacacttgaggtggttgtggatttgagaatttctttcaatggtcctgggaaattttagctatatccagcacacaggttgagaacttctataatgttggtctctgccttgcaacattactcttaaccaaatatctttaaaagtcgtactctttactcttagagttgatttcagtttcattgttgccaaacaatgatatctcaatcatttgacaatgggttgtggcatagatataaaatatccaaattgtctaaatatttttatatttttttataaattagaaccaactaaaggttgtcaatataagagtactctcgcattccaaagtgcttttctgagtgagagagggtgcacagtcagaactagtgtgcttgaattttgctatttaacttcattcacctttacatatctgtagcccctgacatgaatatctatcttcaggcaagtgagtgaatattgccaacatctgtgatgatactggtaggatagggatgggggcaaaacaaaggttgaaaaatcctatatgaccatatccaatacctgaattctcttccactttacttacagaaagtgatttcccactgcttaccccaaaagtacacattgtgtcaaactagccagtctctttatgtaatacccaatatgctttcactctttacaaaataaatttatccttgttgtttcttagacttttttttgcacccattttattccttactaatgtctacgatcacaatcttctgtgaagtctttgttgacaactctagttaacccatacagtcttctttccaaactcctatgttgatttcagtcttacatatttatttatattattatttgctatctcaattgtaaaattctacaattggaaggaaattatggaaattccaatgctgaactttaaaatctttctcctttgagcattgtaaatcttagactgaaatgctttacatataatttagtagatgtttaatattctcaagaggtatgcctaagagtctttgcaaatcaaaaagcagatttatatgatctgatagtcttacttaggagttaagggattcatccctgcccagtagtttcccagtacatgaaattagtactggaggccttccttacatgttagaaccacccaattacccaataggatcaatgctattaaacacattagaaatcactacatatcatggacctttagaaagcaatattttatcacttcatatgagttatttagcttaggacaatgttttgccatttcttatttagattatgagaaatgtcacatctcattttaaaaattatttcttagtatatcacatcattctgattatctgcactaaagcaaaatcttccaaacataaaggagttttcaaaatatgttctaccattagaaattagcatgacggctgtattttcatttaacatattttacaaaaggaaataataggttcatgaatgagaaagctgttttctgtcgtgtctttgataatctgaatttagtctaacagaatagctttcatttaagtattattactgaataattactaacttagtaaagggtttatacctacttagtaacgaagcaggatatttccctgacccctttgtggaactcgcaacaggggtgccttatttacttagcccactgctctcaactcctcactggagggagtgtgcaagcaaacgaggtgggaactggagtgcatgagcactggagcagcatctaggtggaggcgtctgcgacccctgaagccccagagggtgtgttacagtgctctgttagctctgccatccacggacagcttaggcgttaacagctcagtgggccatttgtcttttcacaggaggcagctgccctccaccagcaagggcaaagggccttttgtattcacacttgtggctcctgagctcttgtccagcatctagggaaaatgaggtcacatgaacaaattgaaggattgtaaatgtgagggattgtactgccgatgaaagtggctctcagtgggaaggggagctgaaaaggggatgggggtggcaagtaatcttcccctgaagtccagccggattcttctctaaagttatgccatcaagttgtccctctgaagtcaagctgcttctctctgatgtccagctgtagtcctgtctaccagctgagtctggggtttttataggcacaggatggggtggggtggggccatgggtggtttagaaaaaggcaacattcgagcaggaaaactgggatataagttcccactttgagctgcggtttcaggctttttggcttgagggtggggttttcgctggggaccatcccttttctgcctagagcttctctgcctcctgccgctatcagtacgagagttgtgtaaatgcctatattgatacaggtgctcctcaacgtacaatgggattatttcctgataaacccatcatacgttgaaaacatcataaattgaaaaacccatcataagttgaaaacatcataaattgaaaaatgcatttaataaacctaacctactgaacatcattgcttagcctagcctaccttcaacatggtcagaacacttacattagcctacagttgggcaaaatcatctaacacaaagcctattttattaaaggtgttgaacatctcatgtaatttattgaatactgtattgaacatgaaaagcagaacagttgtatgagtacttgaagtatgatttctactgagtgcatattactttcacaccattgtaaaataaaaatatcctaagccgaaccattgtaaatcaaaacatttttagattgggaccctctgtatatttctttatttctcaggcccttgacaaaaggagataattgaagcattcttatttttattaaacagtgaacatatgtgctaacaaaggaaaattatattcagagaaatcagcacttgcccttgtattacacaggaagtgctaaaagctttactctttagagttaaatgctaagaaatttagattggtataggttacatacaagttttcccgacaattctatatcttgaaaaaaaaaatctaacattgtattatctgagactacagcacagttggactggtttagactaaaactagggtaagggaagtggtgttaaaattgattgaagattatagtatacgtctaaaatcttgggcatcattaataaagcccactctacttggacttattgctctattcatatcctttctgaaagataaactacctcaaaattcaggacccaatagtaatatactattattgcggagatgccatgaaacattcctggggctgtgatcgggatgattgagaggagcgctaaatgctgaaaagtggatgtgaccagggaatggcttagctgtttgccagtgtaaaaaataacttgatatcaacattaagcagcagctgaagaatcttttaatagtttaggcactttttctaaatccttcagttatgcttcaccgattaaattattaagaacctctgatctagctatttcatattttagatgtgagtgaagatgttttgaaatcattttcattgttcatggtttcttgttttttaaaattaaacctagaggacgctgagataatctctttttattaggtctgcagaaaccaagaatacaccaaatgctgaatagctgcatggaagtatcacttgccttgacaatattgtattatgataagctagttcctcttttttttttttttaagttgagctatatagattccaattaatgttgttaaaccaattgtttaaaaaatggccagaggcttctactggcttttagatggaggccaagatatgattgcgtcaaagatcaagataaggatcagaaacgaaatttaggaagagcctcccaatgtgaatgactaaattgtatatgattaacttttctaaaaatacttctcgttgtcatttagtttataaatagcttgcagataatattgtcttcctataggttcgttgaacaaatattaactgggtacctttgggcccagtgtcaccccaatggagtgaatattgttggtggcttaaacaacttccattcaaagatatccctacacccactctgaaattctgctttctaggagaattccaattgtcttcaagtttctacggaatccatcctcagttctggagatggatttagattcacctaaatcttcgattctaagccagtcaagataatctcatcctcttggttcaggaagaaaagtttaaatcaaccagcttatgaaaccattctgaatcatctttagtacaatagtagatatatatgaatacctaatacatatactaatgatacagtagatacacaattaaaattttgattgttcttatctgagggtgaaatctctgaatctgtgaggtaagtgtttatgtctctcactgtaacaagaaattatgttacccatttgttgctggcagtcatcttggaacctggagggcaactagtgaggaggtcaaagctgacgcagagaaaaaaatcaggacaaagaaagtcatagagaaagagtgacagagctctgcttgtacttcatctggagccagctttaacctctgaacttccagttatgtgagttgaattattcttatttttgaagccactttgaaagtgcattctctttcttgcagcccaaagcatcttaactattaaatatgtcaccagggtaacataaatatgccaacaattaatctcagtaaaatattatgatacttgctgaaataggagtaaattttaaaatgataatatggagagagaagcacatgcattcccctggaggactaagtaggaaaaaaggtacttacacaaataatattataaactgagaatgtaatggtaagtttaccaaagagcctattatgacaaatgtatttctagcaaaaggaagaatatatgttaaagtataaaggcagcaattggtgattagggagttacaaatagtttagtattacttgatttttcaagagagaggagggaagatgtaggaaataccctagatagactagtaggtaccaaatccatgaacggccttgtgtaccaagctgaaaaatttagcttttatcctagaagagaaagagaactattatacaacctttactaatacattatgattggcatgttaaaaagtgtagttttaatggatttgcagtgtacaagatgagctgagagacagaaaaactagtgaagaggttttgtagaagatgctatctgaatgaatgagaaaacaaaattgcagtgctaaataagagataagaaatttcaagcttatttgtcttaacaagatcgaaaggattggtaatttatcgtggggcttaatattaaggaataaagaaagtgccagaaaaacttcctgatttttaacatggccagtccattagattgtgtcattcacaaaaatagggaatatagtaagaggaatagattttcagaaaataatgataacatcaattttacatatcctgagttagaaatacctgtggaacatctacgtggtagcttgtcagcaggtgaaaatatgagtttggaattgaagagagaagcctgaactagagataatcattggcatagtttcagtagtcttaatcttagattctctaataaatggaattggtagtaaaattatttgaattaagataatgctatagttcagatgttgtcccctccaaatctcatgttgaaatttgatcctcaatattggaggtggggcttaacgggaagtgtggggtcatgggggtggatccttcttgaatggcttaatgcccttcctgggggcaggttgagtgactgctcattctgttaggttctgcaagagctagttgccaaataacagcctggcacttcccctctctctcttgtttatgctctctaaccatgtgatctctacacaccagctcccctttgcccttcaccatgaatggaagaagcctgaggccctcatgagaagttggtagtggtgccatgcttttttgtacagcctgcagaaccatgagccaaataaaccttccattctttataaattgcccagtctctggcattcctttatagcaacatacatgaacaaagacagatggtaaattttccgttatgtgctgtttgccacaataaaaaatttaaaaaaattgacaataagtacaggataggtgatggccaatcagccaagatgctggccatagagcaatgcagactaggaatgggttaacttccaggtgatattaacactgaagagggctaacagggaaaaaagtaaactaagtagaaatggttggaagtgaccacagagatcactgaaaaaccaaaccaaaccagagaatgtgcaatctcagaaactaacacaatagagaatttaaattgaagagggataggtgatccttgggtaagactatttaaaggcactgagggtgagattacagaaccctagcaaagggcaaaacagttaataaataaaatcttgtccagtagattaatactaattacgtcttaaattaatactcaccatgtgatgcaatttaaaaaacaattatatttaccaagaatgttaggtaaaatgtgcataaaaatagaattacttgacctaatatattaataatttgaactcaagaagcaaactatagtaagaaagacagagtagaaagttttcaagtcaatggattactgaagagtacatgtgacaggcaaataaacactggtagataaatatattaaggaatttggagtggcagattctttctgacatataggatgacaaagaatgtaaaaaatgaaagactggaacaaaaatcagaggagataagggacatataaagtgaaatataaagaaccaggaagatttataggtggtaagaattggaagtgaccaactggtttcaagaaaacaaagaatcttcagtgagaggagctgaagacaggcgtgatgtggcaacctccaaaaaaagacttaaagtgaatttttccgctactgcaatatttttttgttctcaaacaatatttttgcttttcttttataggtggaaatagtgaggatgatagtacactgaaaagacatttcatggttctgacattcaaattgtaaaatatatcgggttgaatgacaaaattacttcatcccccttttaaaatttctatggtacttttgagtctcaaaatcaagggaaaactaatacttttgaagctcatacagtttttgttctagaagttttgtcttttttgtgagcataaatttacccagtgggttcaggaagaagatgagtatttttttttttcaaagcaaacaacgagacagcaggaggttgaaagttctccacatggagttgtcactcaagcactgacatcaaaatcaatgaaaagtggctccagtcttgtgctaagtataatttgtagcagagaggaagttggaggcaaagtgtgaggagaagagagctgagaaaaatagatagtcagatattcagcaaacacaggggaaataaagaggaataaaccctaaagttggcaaaatgatccaaattccaaatggaatgaagtaaaaaaaaaaaaaaaagtggcagcaccatgtagtgcaaacatcactggactgagaatcatttgacaacagacactctgggagtctacttgatctgggcaccattctaggcactgggagtacagtggtaaatgtggcacaggcaatggcctcatggaatttatattgtgatatagaaaagagacaggaaatatacatttaacatcattttagattatatgaaaggcagtaaagcaaaacagagccaggaaaaaagtaagagagtgagagggttgcaagttgggctagggtctatgaaaaactagcccttagctcattatgaaggtttggatgagactttttatccctctaaatttccttagctcccctagctagctttgtctctggaacaagatgacagtttatttcatctttatttccatttctttacatacttcctcttttactgctactactcattctccacttctctttttcactcccctttggtactccttgtttccagaagactctgatccccagctcaagggttccttctctgtactgagtcttgctcgtaattatcttgtgtaacttcaggatttctatattgaacaatacgctgatttctatttctgccttcctcattcattcccaggtaatggggattcaatgaaaatcgacaagaggggatgttggttgtattagtctgttctcatgctgctatgaagaaatacccgagactgggtaatttatgaagaaaacagttttaattgattcaccattctgcatggctggggaggcctcaggaaacttacaatcatggcagaaggcacctcttcacagggtggcaggagggagaatgagtgccagcaggggaaacgccagacacttataaaaccatcagatctcatgtgaaatcacccactatcatgagaatagcatgggggaaactgcctccatgattcaattacctctcactgggtccctcccatgacacctggggattttggagattacaattcaaggtgagatttgggtggggacacagccaaaacatatcattctgctcctggcccctcccaaatctcatgtcatcacatttcaaaacacaataatgccttcccaacagtcacccaaagtcttaactcattccaacattaacccaaaagtccaagtccaaagtttcatctaaggcaaagcaagtcccatccgcctatgagcctgaaaatccaaaacaagttagttacttccaggatacaatggggggtacaggcattgggtaaatacacctgttccgaatgggagaaattggccaaaataaaggggttacaggccacatgcaagtcttaaatccaatagggcagtcattacactttgaactgcccaaatgatctcctttgactacatgtctcacatccaggtcatgctgatgcaagaggtgggctcccatggccttgggcagctctgcccttgtggctttgcagggtacagccccctcccagctgctatcatggctagcactgagtatctgcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacatgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggtttttcttttctatcacattgttaggctgcagattttccaaactttgatgctctgcttccctttaaaacaaagttccaatttcagatcatctctctcaagttcaaatttccacagatctctaggccaggggaaaatgctgccagtctctttgctaaagcttagcaacagtgtcctttgctccagttcccaagaagttcctaatctccatctgagaccacctcagcctggacttcatcgtccacatcaccatcggcattttggtcaaaaccattcaacaagtctctaggaagtttcaaattttcccacattttcctgtcatcttctagccctccaaactgttccaacctgtgcctcttacccagttccaagtcacttccacattttcaggtatatttacagcaataccccactctctgcagtaccaatttactgtattagtccgttctcatgctgctatgaagaaatacccaagaccgggtaatttataaagaaaagaggtttaatagactcacagttccgcatggcttcagaggcctccggaaacttacaatcatggaggaaggcaccttttcacagggtgataggagagagaatgagtgccagcaagggaaatgccagatgcttataaaaccatcagatctcatgagaactcattcactatcacgacaacagcatggggggaaacaaacccatgattcaattacttccccctgggtccctcccacaacacatgggaattacagggattacaattcaaggtgagatttgggtggggacacagccaaaccatatcattggtcaaagggcacaaactttcagttataagatgtctggggatctaatgtacattatggttactatagttaataatactttactgtttacttgaaatttgctacaagactggatcttaagtgtcctcatcccccccccccaacacacacacaatagtaactatttcttgtgctagatgtattaattaatttgattgtggtaatcatctcacaatatagtcatataaaatcatcatgttgtataccttgaatacatacagtttttatttctcaattatacttcaataaagctaggtaaggaggaggcagagtatgtcctcaagaagctcacaattgagtagggggaacaacatgaattcaaattgtcccacaaataaatataagatttggtgtgtgctctggaagaggagtataaatagtgccatttacactaacctagtttgggaggtaaggagcgtctttcctgagtataacatttgagctgagacctgaaaagtgagtaggtatgaggtcaaaaattcaaaaggatagtgtctcaatcagagagaccaatatgtgcaatggctttaaaaaacagaaaataagcactttcataagcaaaacaaaactaggagggaggtcaatgtggagataagagagtaagtagttcacagtatctggtataaggatgatgaaatggaaagggtcacactatacaagatcctgtgggatatcatttctttttttgaaatttttattttgagataaatggtaaggtactggagcattttaaacagagttctgtctgtcatcaaatttatattttgaattttcacacagctaagatgcataggagagaagaaatgaatgaggagagattaggtttggatgacagtattatttaacccaataacctgcatagtgttacaagtgaaaggtgggactattagtcactctgaggcaatgacataaagcatgttttctctaggcaaatcaagactatgatcatcctaatataagactactgtaacagtccaggaaagagatgatgagattgtacaggggtatgcaggataaatctaaaaatgaaagctgaaccaagaaatatttaggagcaaaaaaatcaactgaacttagtggtggatgtccagcaggggtgaggtgggaaggttttaagaatgacccccaagattttgttactggatagctaagtggtgctacaaaacctgaagaaaggaatatatcaggggaaggtcatgcatttcatagcagtaaaagatcatgagattatttttgagacatctaagtggaactgttgagtaggcagttaaatatgcagtatggaatacagaggaacttttttcatgccttaaagtcttctcctctttcagttccatttttcttattgttgtctttgggtcccctgaaaacagggcctggatgaggacttgggtacagatagctcatttggaagctgatccctaggaagcaagaatgaaaaaccaaaagagtgagacagagggggaggaaatgccaatcaaatgtattatcatcaaggtaatgcttatggaccatggggactgtattttgacagaacttttgtatgttcctgagaatcacagagaattccccttgcccccggaaggaatagtggttaaaaatatatccatgggctcccatctccattggttgaaggttgctcactcactaaaacttcaagggtgagaaagctcacaaaatctgtgggctcctgggatgtcagagaagtcccttagatagaaagtagaaaaatgggagccattcccttgacatgggatgctgtcagctaaaggcaagtctgaactcacacagggctgtccactgcagctgcaactgcagtgcaggaaaatggcgtgtgactccaggcaccaggggaatctgttacaattgtgatgataatcttttggaagcttttattttcttttacagtgaaatctgtcttatctatagatgattacatagaacgtacacataaagtgtgaagaataattataaagcaacactttatgtaaatacaaccccaatcaagaaatagaatactgctaataccttgaccccacccttgtgttccccacagcacaatcgcctccatctccctggaagtaaccattctcctgaatttttctccttttcttttctttccctccctccctccctccctccctcccttccttcctttctttgtcttcctctctctctttctctgtttctctctctctctctctctctctctttctttttattttttgagacggagtttcactcttgttgcccaggctggagcgcaatggcacaatcttggctcaccgcaacctccacctcctgggttcaagcgattctcctgcctcagcctcccgagtagctgggattacaggcatgcgccaccatgcctggctgattttgtatttttagtagagacacggtttctccatgttggtcaggctggtctcaaactcccgacctcaggtgatccacccacctcggccccccaaagtgttgggattacaggcgtgagccaccgtgcctggcctctccttttactttttacctgctgccttctccagcctagatgtttaggtgttcttaccctcgagacttcagctttgttttatcataacgctggttaactctggcatccatatttttagcctaaacttctctcctgactcatatgctcagttacctcagtggccttgcaaaactagatgtctaaaattgaactcacagttcccctgaaccctaaaatactccatagtttagtaatttctaccacggtctactcggtttatcaagccaaatgcctgggtgttctattcgcgttctctgtatctctccattttatgtccaatcagttaccagggcctgttgtttccacgtgccaagtatcacttgaatctgtctactttgtctccattccctttattacttctttagtttaggtcattattatctatcacctgaaccactggaatagcctccaaagttgctcttatccaatcagttacctattcttcagccagagtaatccctctaaaacccaaatatgctcatgtcactagtctctctacaatgcttcagtggctttcaattacccttcaaataaaatgtgtttgatttctctaacatgtcttaaaatgcagtttgcgaacatgcatgcatttccagcatcatctggaatgtcctccctgacacatcgctcctcacccattcccaaccccaactcagtgcttcagccatactgatatttttaaaacgtgctaggctccattttgcctccaactgttacttgtttctcttgcctggaacactctcccctacttgtttgcctaggtacacctacttatccttcaagtctcatcttcaaatttccttttttttttttttttccagaatttttcctctgacatcgctctgttgcaatactccagactgggtgaggtgattcttcctgattcttccctagtattctacatcctagtatttgtcacgtacagttatttagttttcttactttctaggagtctaggaatcacgcttatcttgatccatattgtatccctagaatctaacacacaggagggcacacagtaatccttaataaattatttgtcagattagtatattgataaattaaggatacaaatgagtaacctacagttaaagaaggaactgcaccagttaagtcaaatagtgtactggaaaatggcttcttatccccctgatggtgacatctcctgctgcctgtaactatataatttaactcttcctaactaattcattatttaaatgatagtcagttgaagtggcattatcatagctcttttctgctaatctatgacgctgctttgggagaccattctacctttgtacaagtatgccatttcaagtttcaaagaaagctgagatgtggtgtataacattttaatctcgagaactatgagcagtaattagatttcccataatatcgaaattattacttctacttaggtatatttaagggtacttcaatatctaaatatatgggacttatagtcatgagaatttagaaaatctaagacctagttatcccctttctttgtattttttgatgctgagataggaaaacgttatccaaagtgagaacaaatgttttaggctcgagtccttttatataactactactcatcattttttcaaatgatagtggaacactcttaagagttgtaccaggtatttcacatctctttattctttccatgagtggctttataaatgtccattctatgctaagtaagtggtattctttgttctgagtaagcattaataacactgctgatgataagaaatattttttcccctggaggaagccttaagaagattagggaaacacattaaacaatctatattccctttattagctacaaggaatctattgactagtatttatctaaaacaggggtcagtgaactacggcttgtgggccaaatccaaccaactgcctgttcttgcaaacacacttttattggaacacagccacacttatgcatttacaaactgcctatggctgctttgcacctcattagcagagttgagtaacttcaacaaagatcttctggcttgtaaaacccaaaatatttactatctggctttttacagaaaaaattggcaaaacttcgaccaaaaccttcttgaagtgacttacattactaacctatacctcccgctgaaacagtaaattatataaaccaataattgactttataaatatggattttttatttgcctcaaatcgtgtcttccaagattcaaatggcatcccctaattgcaatgtattatgatttggtgaataaattcttgttctcactactgtagttagaagaaaaatggactaggaatacgaagagaaaagattctgtcctgattctcctcttattcagtttcctcaactgcgggaatttataatcttcattcttaagggaaattttagataatatatacatgtaaacaattttattattttttgatcagatggatttcaatattttgttttcttcactctagggttcactaactacagtcataacttgtttcagttgatattcatgtgacagtctgatcaaatgtatcatttgttcagttattctgctacctccaatttattccttgagtgtgcatcccttggtatggcttattgctgacctcattatttctgcccacgcaggtctatccactcattcatctcaatccacttgcatccatggccttgctcacactgggttttactataatgcttcagatttatccagatgagaaaaataaattccagccaagaagcatgcttaagtgggacactggctagaggaaaggtcaacaatatccattatgataagtggtaacacctctgttaactccctttttattttacagaaattttattatcatctagtccagtgacttttagtatttttaaagcatacaacccttttttcaagtgagctcctaagaagaaatccggtatgtgaagcctaaaaagggcgagagcaacagactggttgaaattgcagatgggaggcaaagggaagtatgaacatatgttggaggaaactctacccttttgacggccgaaggggacgctttccagaagaggtgatgaactctatgtttctggtttgtgtgattgattgaagttccagcccatattcatttctacgatttcatgctgtaggcaattgggtccacttattcaccacagccaccgaacaaagaaaacactagaaaatactttcagagaatcaggtctgaacacaaaaaagaattttccaagggagtcgtggtgcccttaagattaaatgaagtgctgtttaaacatatttatttaattgattttgacttgcagcagggtgctggactatggtaccctatagattttccagatctactttttgtaattctgctgctgtactggctttttgaccttgaattgacagttacagatgtgggagaataaataaagctaagtagtaacactgtgggagaatcaagcctatcatcttaatgtctttttctctcctgattgccttctattctagaggagccaaaaaaagaaaagaaaagaaaagaaaagaacgtatatatttcttcatattgaaaccacttccgtaactctgaggttatagtattaagcttcaaaggtactactacttaaggcccaattccacccacggagatttaataaaagatttagatgtcatgcaaaacggaaaagaaaggggaagagagagtattgttgtttaatttcatttggaaaatatgtacaaaagcatgcacaatatggtagaattggtcctagagtatatggagtcttcattcatagactgcatgaccaagattcagtatgtttaacataaaggtaaaagacaggcatgaactttataaagactcaggttcaaggccatgctgtgcccacttagtagctgggtgtttttggataaccattctctctaggctttcatttcctctcatggtgaaaaataataataatgtagtacctatttcataaggctgctgtaagattaaacagaaaaatgcacaaagaatacttggcaaaatgcctggtacagagcaaggcattaatgcgtgttagccctaagataaatattaggtatgttcgggtcaatgcaaaagctagggggaataatcgaaatgaaagcaggtattatttttgaaaatggctatgataggcctatatattactggaatagaaccaaactgtgagaccttagagaccctccaggagagttaaacatgaagtgacaatgttgttttgcctgatttacatcagacttatgttgttaaagcaccccttttttcaatatgaagcatttattcacccagataatggatacaaatccatgcattcaaatgttccttggagtcagagatcaagatggaaatccccagaatcatagagatttgcgtctgtaaactggcttattatattcacattcaaagaggttggaaggggcagtgtcagctttttaactagaatcttttcattacttctccctgttggggttgcaacacatgctgtgagtgacctccagagattcctcaagctgtatgcaggcagcaaattgaatctgaaagctttattagacaagtttttcttgtctttcagctggtgggagtggatgtcagttgtattggaaaaaataaaacttcttgtgaaactgggtcctgaccttgaaaaaaaagctcaaatcgaagtgtacaattcaatcctgagttatgtgcttatttgttaaacagtgtgcaggttcaaaggaaaagggcatattttaccttaaagaaataagaatcaacaataaaaataataggagttctgttttgatcatgctgaacttagtaagcaaaagtgcctatcaccaaatcacatagttatgaaaagtatgctaataatcgaagaaacaattcccattcacttcagtatgacaagaaaactattataatccataatgaacattatagaacatttatttatattgtgtattcatacatttctttgagaataaagaagagtcctgggaaaatgaagggacattggagattggctagtttgttttatttcaatattgtctctcatatatacatataaaatctcttatatatatatgagtttatatataaatatatatgagtttatatataaatatatatgagtttatatatatatgagtttatatataaatatatatgagtttatatatatagtttcctatataaaaactatatagagatatagctatctgtatatataaccatatatagtgacatgtaatatatatataaactatatacagttatatgtctatatagctatatatatatagtgatgtaatttagttcctggtttttaatattggagaacaattatgagtttttttgaaggtgtgataattattccagaagtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacagtaactggaacttaggttaggtagttgaaaaactgtcaagtatagcagattggtagaactccatctgctcttcactttttaagaagagagttggcagttacgcttctaagattgcttctaatagaatgagagcctttcctgagatagtggaaaagaaagaatgactgttcaaatacttttcagaccacaatcttaaaatcgacaattgaagtacaaaactgctacaatttcctttcgaaatcttgtttctctctgaaggtaaagttatattcaattttaaaactattcagtgaagttttaggaaatattaggaatacatgttgaagccttccattttgagcggtagggtacttactctcataaatatgcctaaatagttctggtttcttggtcagagtatgacagtcaagattatggtatactctgtagtgatttcaagcaaaagtcctttcttgaagagtgttaaatagcataagaaggttaaagtaagtttactgtaattaacattttatttctgttaaaatgcaggacataggtaatcaaaaaatctctaatcatcagaattgatgttagccttctctttttcctagaaatgatgaactagagtttctcttccttcatcagttcagaccccaaagcacaaccctaactggaaatggtaaccatgcaataaaactaccaaaaggttaagagagggagaagaaagggaacttcatcacaaaatggataattaacatctaaatgctgaatactaaatactaaacagtagaagtttcacattctatcactgtcttggatgttaacaatgatgccactgtagtgcctttcctgttaaccagtgagcattgttgaaggacctggcctgggaccagggaccccctactgccttcatggaaagacttccttctgatgagtgtgagaagtgctggggcctcaccagccagggctttctgttgtcactcccctttctacagtgtgacacatctcattatatttcaagcactcttacctcactgatacatacaaatatgaatttttaaattaattaattaatgtcaagagttaaggagtctctccagctgctccaaggccttgcagtatcttgggatagggtttaaaatggatttattttgttattggaactgattaagggtcttcacattttttgtacaaaagcttgctcctgacgtattagactttgaggaagttttcaaggtttagagcctgtaactataaaaccggcaatagtatagccatgtcgtaagtgtttttagcagagaaatcatctgttaatgaggaagaaaaagatttggcctcacggaaatttatttgcctaatcctaaaggttcacctgaagcagaatcaacagtggaaacataaccacaacaggaaagggtgtgggttatatacccctcccctgccatgtttctattaatgagaaggatcaggacccaagagaggaataagaatgcaagaactaattgccatcctctttttcctttgctgcagataaacgaaggccattttcacaaaaaaaatgatcactgcagataaatgtagggtattgtcacaataaattaaccattttttttttttgcaatttaagccaacaaaagtagtatgacaagagtacatttaagtgccaagtaacctcatgctttaactgcctagatatttaaagtattattgaaatggaaatggaatgctttatttaactttgtagaggtgagtgaagttcaaattaaaatgtataaatcaccatggaatactatgcagccataaaaaatgatgagttcatgtcctttgtagggatatggatgaagctgtaaaccatcattctcagcaaactatcgcaaggacaaaaaaccaaacaccgcatattctcactcacaggtgggaattgaacaatgagaacacatggtcacaggaaggggaacatcacacactggggcctgctgtggggtggggggaggggggagggatagcattaggagatatacctaatgttcaatgacgagttaatgggtgcagcacaccaacatggcacatgtatatatatgtaacagacctgcacattgtgcacatgtaccctaaaacttaaagtataataaaaaaaagttaagcaaaaataaataaataaataaaacaaataaaaaggtataaataaccttatatgtgaggatttgatattcaatttaaatagagacttcaaaaaattcaaatgaagataactaaatcactgcttgatacatggtgcactgattaatagcataagctctggaatcatagagacttatttttgaatacccactctgtcactgactagctctgtaaccttggacaaattatttaacctttctgacccttggttatctcatctataaaatgggaattgcaacataacttactcaaaaggtataactgtggcactaattctaagacttgtattaatttaggtttgctcagaagtagaccctgagacaaggatttaaatacaaataattcaattgggagctgatcccagaaagccatggtagaagagaagatagagctgcagagctgaagatacatatatatctgtcagttgtatctcagcagggaacaaagttgagatatatgagaatactgaagaggactgaaatcaaactcaggagatgtggggttgggtccagattctgccaaaatgggaagaaagcctacacatcggaaggaagcctatacgaggcatgctaataagtatgcttatcattgtggtcaactgcccaattcactggagatttttagtgtggaacatgcattggaggtgtcctacccaaggggagaagaaggtgggatatttattgatatggtttggctgtgttctcacccaaatctcatcttgaattgtaactccaataatccccacgtgttgtgggagggaccatgtgggaggtaactgaatcatgggggtggggttttcctgtgctgttctcctgatagtgaataagtctcatgagatctgatggttttataaagagcagtttccctgcacatgctctcttgcctgctgtcatgtaagaagtgcctctgctcttccttcgccttctgccatgattgtgaggcctctccagccatgtggaactgtgagtccattaaacttctttttcctgtataaattatccagtctcgggtatttcttcatagcagtatgaaaactatgaagaccaacacctttatcccccagcttttgtccattggttaagtgctattccagagataatctcctccccagcttccagcctgctctgcaagtgggagagctactcctacaggcagagaaaggactcaggaagactcacaggtacttgtagttagacgcttcatggtttataggaaggctgagtgctaaggggaaatgggtagcccactaagggtcaaatctatcttacctgcctcgtttctgtaaataaagtgtcactggagcacagccatgtccctttatttaggtattgtctgtggcttttagtatacaatgacagagttgaccacatgacccataaagcagaaaatatctagtatcggtcctttgcagaaacagtctgttgatcccttatatagttggtagcacaactgagatatcagaatttaggcttcttgacctccaatactgtgctttcctaattacacttgagacttgctctctccaaacttaattacaggaagagatgattttaccagtgtttaatcaactagaaaactctgggccgggcgcggtggctcacgcctgtaatcccagcactttggaaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgggggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaaaaaaaaaaaaagaaaactctgttaactggctcttctatatgtccatatacaatgggttattcattccatagttattaccaagagacatttgaatcaaatatcctgatttggagtcttcacattaagcatgtctatatgcaatttctttcaaaaatgctaaatcgggtattgtagaacattaatgttctcaggcccagcagcttgtggataagaaaggattcacattgacatttacaaccagatttgctggctctttgcctccatctgccatgcaagccttcagacccatgcaaagtcctgtctacctaaatgattgtgaaagtctctagaggaacttatggcttttcttctcagaggtctcatccaggaacactgaacagctctgcagggcaaatactgcctggtttagtgtgttgtccatctccttgaacttctaagctataacatcctcggggtggggagatggggagtagaggtgctaaaataagatggatttccctttagcattcacagcactggatctcattggaatcccactccttgctgcacacagcagaagggatgaatttattcttccccactcactgtatgtctgtggtagtagttctcaaagcataggccagcatcagcataacctaggaacttttcagagatgcaagtcttggctgggcacagtggctcacgcctgtaatcccagcactatgggaggctgaggcaggtggatcacctgaggtcaggagttcgagaccagcctgaccaacatggtgaaaccctgtctctactaaaaatacaaaaattagccaggcgtggtggcgggtgcctataatcctagctactcaggaggctgaggcaggagaaccgcttcaacccaggaggcagaggttgctgtgagccgagattgcaccactgcactccagcctgggtgacagagcaagactcagtctcaaaaaaaaagagagagagagagatgcaggtctcaccccagagctagtaaatcagaaactctggggttgaagcccagtaatctatactttgcgaagaactgggtggttctaacgcatggtaatttttgagaattaagttggattaagaccaacacttttgatctccagtttccctccttttccccaatgtagtgatttgtgtataaatacggtgacaataaaaccttctatccccaatatgcatacccctttgatatgcgatgtggcatctcctcctttcacgagatgaagtaatttcctcatctcttgaatctgggctgatcttttgaggtgctttgaccaatataacttagcagaagtaacctacacgtttcaaagcctaggcatcagaaggtcttgtagcttccacccgccctctcttggaaaactgccctgagaataccatgtaatgaagcctaatctagcctacaggatgatgagtggccttatgaagaatcaaggttctgcaaccaacagccagctgtcagatatctgagagagtgcattttagaccatctagctcctgttcacttgctagataactgcatccacataagtaacaccaagcaagaccatcagaataactatccagctaatcacagagcaaacttcagacacacagaattatgagcaataaatcactcgttttgaactgttaagttttggggtgcttctatgcaacaatagaaactgatatggacaggtgtctaagcaacaacaattgcaagttttgctttttttttccagtatgttgatttgtcctgataattaaaacaatttatacagctcaggcaaggccaccccattataatttataatttaagtaagcagccacaaggtagtttggtttagtgttcataaaacaaaacaagcaactttaggcctcagcttctacatctataaaagaagaatactcaactagataataattgcaataattattccaagtttggatttctatggttctaagaaattcaaatagagtgaaccaattttttctacttcttaagtagaaaaaacacagaaacaggccagtcaaggtggctcatgcctgtaatcccagcactttgagaggctgaggcaggcggatcacttgaggtcaggagtttaagaccagcctgatcaacatggagcaaccccgtctttactaaaactacaaaaattagctgggcatggtggtgcgcacctgtatcccagctacttgggaggctgaggcaggagaatcgcttgaacctgaaaggcagaggttgtagtaaaccgagatcgcaccactgcactccagcctgggcaacagagcaagattctgtcacacacacacacacacacacacacacaaagaaaaaagaaagaaagaaaagaaaaaacacggaaacttgtatcacttttactccagataaatttaagattgagttaaattatattaactgctggccagctgcatctgtatctgtaattttccattaggttcttggacagagagatagtgtaaagcacagccacaaaacaaaacacaggctgtggagcttgacatgtggactgaaacccttgcttgcttgctttctagctgtgtggccttaatctagctatctcccctctaaacctcaggctccttaatctttaaaaattatctatatgttctttgcagttattttgaggataaagacatatatgttaaagctacaagtatatgtgtagcttctacatatttaatagtaggaatgcaatggaaacaatctgctataatgaattataaattctattacattgtaatacagtacatgaaataataaacatatacaagaagcataatacaaattagattttctttttttatattgcatttatttctgattaacttcctgcaagtcaggaagtcgggaatagaaacaattctttattctgatatttgaactaccacagtaaagaaaaaagaaaatcttattttaataaaagcagctctgaatttaaatgactaccttttgttttttttttcattcaacatttgtgtatttaacatcttgacttaatgctcagatctgtttcggtttgctaaagaggatgaaaagcacctgcttttgagaaaattcctctttcccttaattcttttttagctactaccacaactctgccagctatcaccaaacagctttgagctgagggcattcccagactctccatactggcagcaatgtggaggacataggagaagacaagagtggtggggggtgatgagaccctcatgttggggagaaggaagtagggcagtgctatgaaagatgagtatctctcatggcttccatcacacttcccctgacccactcctctagtctcactgatctccttaatattccgtcatcttgttcctacttcagtatcgttgctcagtcttttctctccctgcctggaataattttcccagaaatacaccaggctcacttcctcacttacatcagttttctgatgttctcttaacagacaagcttccctgaccacactatagacaataataccctcatcccatctccctgcttagttgttctctgtaatggtgtttctcaaatgtcagtgtgcacaggattcacctggggattctattaaaatgcagattgtgattcagtgggtctaggataggggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaatttatgaataccttctatcaacaactgaagaggaaagaaaataaaatagactgaaaatatgcagtgaaaacaaaagttaaaactacagctaaatgaggaaatattcctcccccaagtcagcttgtggtcctcccaatccatttttctttttcttgaactaaaaatgggagagctcttaaattgtttgcaaatgggacagggagaggtgctagtaggactgtgtgtgtttctgtggtttctgtgatttttgtagacatacttgtccctcttcaggaacaatgcacacatccctggatgctaggaatattggttgttaatggtgttccttactaagaattgccttcggcctcagaaaacttgtccaagttgtccttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcataaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggctttgaaaaatttagtgaggtttccacattttttttcctttctattgctggaagcagaagactcttaggtcctacggcaaatctttacaacttactgaggagagaattaagtcctaacgccctagggcagttgttctcatactttaggatcaacagaatcacctggagaccttgctaattgctgcatggtagccccggagttctggatttagtagatactgggtggagcccaataatttgcatttttaacaattttccaggtggtgttgatgctgattgttcatgacaaaatcctaagatatctattacacctaatcagttacctgagcatttatcatagactagatatgtaccattcttgagaacataatagaccctcagatcattttcaataggatttcatcctcttgcgaaacccgagcagagaaaagctaccaagggaatggcaggcagaggaagaagatgaacaggacctaggtttctgcaataacatatgtaagaaagctgcttgactaggaaaacatacgctgggttgtcatgtgagcaagaaaagaactcctattgtgttaagccactgaaatatttagttcattacaagcagcaataccttaccagtatagtagcactagtcacaaaagctttaccagtgcctataagagataatagctgcgtttttgtatcactgtaaattcctatgcttaccttatgaggaatacaaataacttgattgatgtcgggtttggttaaaataaatacattagcagaaattgcatttctagtctgaagaatcagagttggaaaagagccagaaactacaaactctttaaataggaatggaatgaacccaacctaactggaatgtttcatatacacgttgtagtttaatgctaatcattaatttaatgcgaatcatttcaatgaaaccattactttatttattccagaaaaataattgttcaggtgctactctgtgccagactttgtgccagttactaagcttacaaaactgaagttcgtaacctctaagcattcacagacatgtaagtaaattagaacagagattttaggaaaaaataatgatttcaacaagacacctcgggggaacagcttaactcagcctggagaggtcaataggttacccacaaaagctaacatttgaatttattttgaaagacgactaggaagttttcagaaggggccattcaagcgccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctaacatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgaggtttctcttcaaataatctgatcaatcttttattctttaattcatagtaccccctgatttttctcctttttcctttttacctttgttagatgcccaggcacacctcagtaccagctcacattcatttccttatttggaaagaggactaactttctagctcattacagacgccccttccccttcctctccacttgattttacgtgcccaccctatctaaaaaaatcaaatgtttagccaactgggattagtttagattgtacgacccaaccccagccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcctctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcgggagagcagtggcaagatctcggctcactgcagcctcgacttcctaggcaatcctcccacctcagcctcctgagtagctactcagtactactactgagtagtactactgagtacatacatttttatgtagagacggggttttgccatgttgcccaggctggtctcaaactcctggactccagtgatctgcccatcccagcctcccaaagcgctggaattacaggtgtgagccaccacacccagccttattaggcttttataaatcctgaaccaaactgtatttaaaaagtaatctcatagactagggtcacaaattcaggtccctatagggactaggttgtaacaaagggaagaataagccttgtctaaatcagagagctataacttcagatgtggctgctgactgccaacagaaaggtgggcataagttaaaaagcaaaacacagaaaaacaaacaaaaaaccctgctgatcatattccctcaccagtgtataccggagaagtttctctcacattcttaaggtcataaggaagtacaagaaagtttgttgctgcattgtggggaattgaggccaacatgggtatgtatgtgaaagaaatggataagggtatatgtagagcaatgtggatggatttttttcttttttttttttagatggagtttcactgttgttgccctggctggaatgcagtggtgagatcttggctcactgcaacctttgcctcctgggttcaagtgattctcctgcctcagcctcccggtagctgggattacaggctcgcaccaccacacccgggtaatttttgtattttgtatttcaccatgttggccaggctgccttgaactcctgacctcagatgatctgcccatcttggcctcccaatgtgctgggattgcaggcatgagccactgcgcccggccatgggtggatctttaaaacacaattatgaatgttagaaaagctaagaaacaagatttatagcacaatgtagcttttataaatttaaaatatacttataaataatatattttaaaaggataaagcaggaaagaaacaggaatagagatattattgtcacatttcagtaattttgctaatcggttattaaacataaccattaatataaattaaattttataaatataaaataaactgtgctaagaacaaaagataatatatagtaagaattcatcacttcctaatttaactatcatcagtgctcttgagactatgtctattgtgtctgacatcaagtcaaatcaaggctttcaatgtttttatccagaatgcatgatgtaaatatttactagcatatcaataaatgtaacttttttatttattaaaaatcagtcttgaacccaaaagcaaacaaaaaataatgcctctgattagtcaggaaaaccacccttggaagtcatcactcacggaagatattttcctgtcctgacatcagaacctaaacactaaaaattaaatattctaagagactagtgagtaatatatttgatcttctggtttccctgtgaagtttctgtaaccctacaaagacagaatactaaaagcaatgagaagtaatcattctgataacagaaagtagcaataggagacaatgaacatgaaaaacttaaaactgagaaatgtggtaatcttagtcatttatcaatgaaatgacctttcaacatgggatgaaatctcatcctacaccatttaatttataggaaatcacctatatgtgctgagatagagagaaaaggagagatagtgatagattagggattgatttaaatactgctgggggtatgcccatctttccactcagtaagcatattgcccctcagaatgaggataaagagagatcaaagtttgctgtttctatgtttctaccagttgacttaggttccactctcttctcatggtgtaagtatctcagtgatttgagttagctttaatacttaaaggtatgtatttatcttacagtctagcttctaaaagcaaattaaccacttcaactgggtctcaactgaagaaagggtgctttgaatttcatgttcctcatataacactgtatcactaaacagagcaaaaattgatgtgataacgacacccctgaaaattaagaaaagttaatttacattgtgatttagaatcagaagtcttaggtttcgttcctaattcactactactggttgtgtgatccttggaaaatgagatgggtcactaagatttatcatccttgaaacatggatataataataccacctaactcatagctttgttggagaaactaaacgagatattttatatggtaaaaatgctgtgaactacaaagcactataaatttgttggttagatattatgcgctgctcaatgaagcaaaacagaagatattcaagaaaagttctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtataatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaatttaagcagtgctcaatagaaatctgtaaaaggtaacaatttgcaatacatgttaatcatctataagcaaatttaaggaaatcaaataagtacttaaatcccaacttatttaaatagcgtatcagtgggataatagttatcaagtcctattcttgactacatctccataattttaaaactttgaatatgctaactaaattgcaggtccaaggttttccgcacaagagctccaaactcaacagagtgaattcgtgttctaccaaaatggataaactttgggaattcttttgtttgtaaatggaaaaatcagatttattataggtgacttttgcagctgagcattattctccattgtatatactttgcttgaaaatattcattaaatgttaagacaactatatcaaactatgaaatttctgctttatgaagaacaggaattagttacaagaaaaagtgatttctgaatatagctttccttttaaaatttaaaatggataaatatttaaggtgatagatactgcaatcactctgatttgatcattatatattatatgcttgtatcaaaatatcacttgtggtaaaaggacggaaaaagatactccatgcaaatgggaaccaaaagcaagcaggagtagctattcttatatcagacaaaatgggctttaaagcaataaccgtaaataaaagataaagaaagacattgtataatgataaaaggattagtccaacaagaagatatttactacagtactcaatttatatgcacctaacactggtgctcctagctttataaaacaatagtactagacctaagaaatgagatagacagcaatgcaataatagtgggggacttcaatactccatttacagcactagacaggtcactgaaacaaaaacttaacaaagaaacaatggacttaaattacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaaccaaggaaagaagagagaagattcaaataagctcaagtagaaatgaaactggaaacactacaacctacatcacaaaaatacaaaagatcattcactactactatgaacacctttatgcacacaaactagaaaatctagaggaaatggatacattcctggaaacacacaaccctcctagtttaaatcaagaagaaatagaaaccctgaacgctttggctgggcgcggtggctcacgtctgtgattttagcactttgggaggctgaggcaggtggatcactaggtcaggagttcgagacctgcctggccaacacagtgaaactccgactctactaaaaatacaaaaattagctgggcgtggtggtgggcacctgtaatctcagctacttgggaggctgaggcaggagaattacttgaaactggaaggtggaggttgcagtgagccaagatcatgccacagcactaaagcctaggtgaaagagcaaaactccatctcaaaaaaaaaaaaaaaaaagaaagaaaccctgaacataccagtaacgagcagcaaggttgaatatcagtaatttaaaaattgccaaaaaaaagtccaggaccagatggattcacagctgaattctaccagacattcaaagaagaattggtaccaattataatgaaactatttcaaaagataaagagggaatcctccctaaatcattctatgaagtcagtatcaccctaataccaaaaccagaaaaggaaataacaaaaaagaaagcagcagcacaaaaatagcagcacaatttgcaattgcaagatatggaaccaacccaagtgtccatcgaccaatgaatggataaagaaaatgtggtatctatataccatggaatattactcagccataaaaaagaatctcttttgcagcaacttgaatggagctggcagccactattccaagtaaagtaactcaggaacggaaaactaaataccatatgttctcactcgtaagtgggagctaagctatgaggatacaaagacatacggagtgatacaatggactttggggactctaagtggggagcttgggagtgaggtaagggataaaagactatttattgggtacagtatatagtactcaggaaatggatacataaaaaatttcagaattcgccactatagaactcatccatgtaaccaaaaaccacctatacccccaaaactactgaaattataaaaaataagcaaaatataacttgtaccgcacaaataaatatgtacaattatacacatataaaattaaaaataaaaaaaaattttttaattaagtttcctaaggtagctacaattgtggctgctttcttgcctcatattttttggatatttaaaaaatattaaatgatttttatgttttctatcattaagacaaggaaaaaagccttctagaaatagatattatttgatgtagaataagtaaggaaaaataatgtatttgtttaatacaatcataaaaaatcatttgtttaaaaaagtaaactagaatatagttttaaactctatttgagtttgagattttcaaaatttaaaaatatatcttgtgtcaatggttggcatgcaattaatatctactgaataaataaaggactctacctacggctgtatatatacaggcatacattcgaatattgtaactgaaacatctatgtctctttgtctctctctttaagtgtaactaatacaactgaggacaagaggtgaaattcaaatctctaaaatgcttccctaatttcagcatgagctactgagtacatgagacttttcactcaaatattctctcagaaaagaaagttggctcatattcaagactttatactatctcttatgtctcaattattttattcggaaccacaatgttgtatattagcctgaaataacctcaagagatgtgatgcttacataagtattctgacagaatttgcttaattaaaaagggaggcaaagaaagttgataaatctttagcaatcattcctaatgtatagcttcacaatcactcgtggcagagatcattgtaaacgagtctttcaaagaatttgttaaaaagccaaacaacttaaaaagcagaaagaatatgttagtctattgggaatttttaaaagatcacatctggctgggtgcagtggctcacgcctgtaatcccaggactttgggaggccgaggcagcctgatcacctgaggtcgggagttcgagaccagcttgaccaacgtggagaaaccccatctctactaaaaatacaaaattagctgggcatggtggtgggcgcctgtaatcccagctacttggaaggctgaggcaggagaatcgcttgaacctgggaggtgtaggttgcggtgagccgagatcgcgccaccgcactccagcctgggcaacaagagcgaaactccgtctcaaaaacaaacaaacaaccaaaatcatatctaagaaaaatgaaaaaaacagttttcctaatattttgtgaatgggtattgaagtttgggataaaaatttcagcgacagcattgagaacgtgaaaaatagctctgctgatagctggcagctggcagctagctaggccatgatggtcccagctggatgttaaaaaacactcatagaaataaactaggcagacacaaggccaccccatggccgtgtttgaaacaagacagagacaaggcctttctgctatcacagaaatgactaatatgaggcattgctgctcctttaccaacgacgtgtctagccctactttaatctcatcttctagataaacactaagatacctaatcactacattgactctgtttcttgaaagcatctaatccagaaatggcttctactttctgaattcctccttagaatcatgcagccagctgaactctgtaagaagctttttccaatgccctcttactgagatgcccacactctgaagtgttttacgctcttgctgcaataaggtaaatattcttaattttttgattacagatatgttgcttgtaatcttggccagagggctttcagagtattatgtagggattcaaacaatgccatattacaaataacttagcaaggtgatgagctctacaattctagaatatacatacgaagggtttgaatgaaattgtttcataaaatataaatgtgccaggtatttctaaatgagtgtgttattttataaaatgtaagactgcaaatatggaaatgctactcaattaagaaattgaatataattagacatttgacaatctcatccatatttctaaatgtttatgtttacaagttgcccaaaaatctattataaattttttctcttctcattgggaaagtgaagctctcctcaagtttatgcattgggattagcatttattcaacctcttatactccaagacttttttttcagttgtaaagcaaacttgtatttatttatttatttatgagatggagtctcactctgtcacccaggctggagtgcagtggcgtgatctcagctcactgcaagctctgcctcccgggttcatgccattctcctgcctcagcctcccgagtagctgggactacagatgcctgccaccaagcccggctaattttgtttttgtatttttagtagagatggggtttcaccatgttagccaggatggtctcgatctcctgactttgtgatccgcccaccttggcctcccaaagtgctggtattacaggcgcgagccaccgcgcccagtcgcaaacttgtaatttaaaaaaataaaatgttgctatgcatttacttataaattattaaatgcctctaatattgttatcttctttctagaagtcctctcccaacttattctggtgttattggcatggaaattgtgctcaataaatgagtcagtcaaaatagacttgttcatttcaggggacaatttttgtctgttatctctctattgatttctgttgctacaagtgaagttacaccaggtaaatgagattgtacgcatggcagatgatttatgaaatccaagtattgttttaagtgtaattatatttatttcggcaacatttcgaccaatgaaataccatttgacctgctataccgtggataaatcttgagatgcacatcttttgtgagtaatatattaaagattgttaggcaaaaaataaaccctaaggaagtttttaaaaatgttaagatgttgatgttggcagtagaacaaactcattgggagaaaaaaaaacagcttcatctagttaattaacaacaaaacagctgggaaaatgaatcatccctggttgtgactgactgtaattgaaaatgactaatgatgctgtcattttgcagttcatatctgaggaaatgatgcctggaagattataattgccctcttgaccatttgtctacagcaattattttgtgttaaaggttgggatggaacgctttggccaaatacagaaagttcctcacacctttttctgttacattgaaaaataattcaagagcagtaagtaaaacatattactaggtttgtgtaagtaacattttttgataatataaaaagttagcaaagcaaaccagctggcttcattttatcactttagaaagtaaccaagacatttaaaattccattaatgctctcagttctaatacatggcaggtgatgtaagcattgaaagtacataaacatatttttaaaagttaactgaaagtgtagttttccaacttaagttaaaaatgagtatgaatacaagaaaatggcacctaaatgcttaagctcaagacagttaaaaatacaattttataataaaaatcaaataacaaatggcttcttttgtagtttatattgttgttactgatagcagttgtttttgctgcttttaaactgctaaatggggtgctattgaggacctagttattactgtgtggaaaaatggaacacattaaagactatttcatctatggcattaatgtaatatattataccaaaactataactttagcaaaattttaaacaatttatataactcatatagtcagtcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctatacgtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgctccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgatatatggactcaaagtttaaaaaggctttgttcacgttctatcagagcaatggagtgtccttcagaaaaatcatctctaacctttaaaaataaatttttgatccatgcagagatttaaacagccctcacagctttctgccttgtattgctgggtgtcatgttcaaaactgtgaggtcattttttgagcctctaggtgtttcaggctaccgcaaaccccagctaatcttcagatgtttccaaggtcatggtccacagcaaaagttgtgcgtgagtcaactatttttttaaaccccataattctcaaatcattcttgcatttttgcccctatcaacttgatatatatatattttgagacggagtttcgctcgtgtcgcccaggctggagtgcaacagcgcgatctcggctcactgcaacttctgcctctcgggttcaagtgattctcctgcctcagcctcccaagtagctgggattacaggcgcctgccaccacagctggctcattttcatatttttagtagagacagggtttcaccatgttggccaggcaggtctcgaactcctgacctcaggtgatccgcctgcctcggcctcgcaaagtgctgggattataggcatgagccaccatgcccagccaacttgatatgttgatttttctccaaatccaagggagaaatgggaagacaggaataaattttcccttaagttcagcttctcccaatgtgtcaaattgagagaaaatagggaaacagggaaggagaaaaaaaaaaaggaaggaaaaaaacagtgctgtctgctacaaaaatggttttaagggttgtgaaagagaaggaaagcaacagctcctggttctttctttttatttcagaaaagtaattctccttttacatcactaatgcatcagcaggaagcagatatgctcaggcatggcagatcccagttctgatctccaagtggcccagtagttgagtgtgtgggtggaggtgcgataagttagcatcaagcatttggattgttttatacataatgaaagcaaaaattttctcagtggcttttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgaggaataaggaaaatctagttttacttactgaattccaaataggtccccagccactataaattcacccttgaataccgcatttgcaaaaaaacattttggtgtagtaaatggtgatatggtctcaaaatactttaagagaaaataaaatatattattctaaggaagtagagaaaagagcatatcttcagcaaggtaaaaatgatttaagaaaaggaaaaaaagtaactgaattttcaacctatacatttatcatttatgtataccataaattaccaggccaaatatacatgtacaatgtctaaattatacatttgaaattatatatgcattacacatataaactgacaagttaacttaaagcactgtcaccaccattcattttgtatgtgtttctctaagacaaagcactattttctatttattcactgacagctgggacttttcttgtgatagttattgatatagctaattactggtaatagacaatgttttctgattagcttcatcatagctgtagactatattattgatgatagcatagttaccattcgtataatgactactatttgccttccccaaccctgattccaacagattgccactttacagataagaaaatgaagcaagggtgggtgggatagtagtgacggtagtgacaatgatgtgaatagcttgcccacaacctcgtgggatgtgggagagttaatattcaaacacagctaggtctgaatccaaagtttatactattggcagtagtaacagctacgtcttcatatcttacaacaacttaataacatatccaaatgatttgatcaaattatgttatttctaagcattaagaaattttactttcaccatctgaatctgtttgatattatcacatatgctgaaaaacatgccctacctctctgataatagagaatcactatgggtcagagggagacaggcaacttaatgcaacagtcgtcattcccattcattggaatttttgaaaaatgatagcaaagaccattgttcccactgccaacctacagtcttatttaaactgttccaactcctttgcttcctccttcaaaacacatcacaattaatcacattatgtgtatatgtatagttttgaccattcctaaagaattatcctctatgagagtaagacccataactaccttgttcactcatatccctggaagtgcctaacacatagtaagtgctaaacaaaaaaccgttgaacgggcaaataaatactgttgcaactttgagcctatgggaattgagttaagagtgtgtattactagagacatttgttcacgcagacagtcgaaaggttcatggcatagactattttctttctaaataatctgctagagttaaatacagagtctactcttctgcttttggatttcccgtaatgattttttttgcaaaattttacatcttcacgttattgattacaacaatgtctcagaaaactcatttctatgacaaattaaaatgggattattttatacttaattaatcctttcattgacttcctttaaactaaaattccatttatcccacatttttcttcttagctgaatttgtataatttaatctccatctagcaatccaagagaacatcacaaatacaaatgttttagcatttatatgatttagcatgaatattttatataaccaacatctgaatgtgggacctctaatcaggtactttataactattgcacttgaagcatagtaaacatttattagttttgatttgtaattccagtagaagagtaaacttggaaaggctggaggatcatatttcctatacaaatctaaaaacttctatgagtattaaaacctgtgatgtactagcatggaaaagctcatctttcctttcaaacactcccacttcacttttctttttcactcatcgagcataggaagtcaatattctcctcatattcccttaaatttaatgtgtccctctgtcccccaatacagatcatttgtatttgatacatttgatctaacttttgttttcatagtatttatacattaaaaccttttgcactgaacaccaaactacttatattattccaacctttaaaaaagatttatatttctaaaattggagtgcgtattcaaaagatacctgctgcatcatctattcaatatatttataagctagagattgggatacagcactagaaaattttcaatttacaatatgaatatatgtgtgtgatatacatgtatatacatatatgtgtattagatatgataaatacacatatcaacatatatgtataatatgcacatataatacacatacacatatgtgtgagtggatatatagacacatgtatgtatatgtacaggtatacctcattttactgagttttgccttattggctctgcagatactgctttttttttttttttttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctctccttgggcctccctattctgagacacaacaatattgaaattatgccagttaataaccgtactatggcctctaaatgttcaagggaaaacaagagttgcatgtctctcactttaaatcaaaagctagaaatgattaagcttggttaggaaggcatgtcgaaagccaagagaggctggaagctaggcctcttgtgcccgttagctaagttgtgaatgcaaaggaaaaattcttgaagaaaattaaaagtgccagtctagtgaacatgcaaatgataacaaagcagaacagccttattgttaatatggagaatgtcttagtggtctggacagaagatcaaaacagccacaacattctcctaagccaaagcctaatccagagcaaggcccaattctgttcagttgtatgaatgctgagagaggtgaggaaattgtagaagaaaagttggaagccagcagaggtttgttcatgaggctttaggacgaagccctctccgtaacataaaagtgaaaggtggagcaacaagtgctgatggagaagctgcagcaaactatccagaagatcaagctaatatctaagatgatgaaggtagctacactaaacaacagattttcagtgtagatgaagcagtcttctattggaaaaagatgccatctaggactttcatagctagagagaagtcaatgcctggcttcgaaagttcaaaggacaggctgactctcttttgaggggctaatgcaattgatgactttcaattgaagacaatgctcatttactattccaaaaatcctagggcccttaagattatgctaatagactctgcctatgctctataaagggaacaacaaagcctggatgatagcacatctctttacagcatggtttacttactgaatattttaggcccactggccatacctattgcacagaagaaaaaatctctttcaatatattactgcttgttgataatgcacctggtcagccaagaggtctgatgaagatgtaccaagagattttgtttttatgcctgctaacacaacatccattctgcagtccttggacaaaggagtcatttcagctctcaagtcttattctttaaaaagtacattttgtaaggctatagctgccctaggtagcgattcctctgatggatctgggtaaactgaaaatcttctggaaaggactcaccattccagatgccattaagaaaatttgtgattcatagaaagaggtaaatatcaacattacaaggtgtttggaagaagtttattccaaccctcatgaatgcctatgagggtccaagactttagtaggggaagtcactggatgtggagaaaattgcaagagaactagaataaagtggagcctgaaggtgtaactgaatggccgtcatctcataatgaaacttcaatggatgaagagttgctacttatagatgagcaaaacaaagtgttttcatgagacagaatctactcctggtgaagacgctgtaaacaatgttgaaatgacaacaaagggtttagaatattctgtaaacttagttggtaaagcagcagcagggtatgagagccttgacctcatttttgaaagatctactgtgggtaaaatgttatcaaataacatcacacactacataaaaatcttttgtgaaaaaaatcaaccaacatagcaaacctcatggttgttttattctaagaaattggcatagtcactccaacctttcaacagttactactctgatcggtcagcagctatctccgtcaaggcaagaccctccatcagcaaaaagattaagactcattgaaggctcagatgactgctagcaagctttagcaacaaagtatttttttaaataatttcaactattgttttagatttaaggggtacatgtgcaggtttgttacatttatatatttattgggtgatactgaggtttggagtatgatggatcctgtcactgagatagtgcgcaccgtatctaatagttagtttttcaactcttgccccttccttatctcttcccctactagtttccagtatgtactgttgccatctttatgtccatgagtgcccaatgtttaggcccacttataagtgagaacaaagtggtatttggttttctgttcctactaattcatttacgataatggcctccagttgcatgcatgttgctacaaaggacataatttcattctttttaatggttgtgtagtatttcatattgtatgtgtaccacattttcttcatccagtccaccattgatggtcatctaggttgattccttggcttttctattgtgaatagtgctgcagtgaacatacaagtgcatgtgtctttttggtagaatgatttatttacttttggatatatactcagtaatgggattgctgggttgaatgacagtgcattttaagttgagaaatccccaaactgctttccacagtgggtgaactaatgtacactcccaccaacagcgtataatgttcccttttctctgcagcctcaccaacatctattgtgttttgagtttttgataataggcattctgactggtgtgagatggtatctcattgtggttttgatttgcatttctctaatgatgagtgatgtggagcattttttcatatctgttagccacccgtttgtcttcttttgagaagtatctatatattcatgtcttttgcccactttttacatggggttatctgcgttttgcttgttaagttccctatagattatggatattagatctttgtctgatggatagtttgtgtatattttctctcatcttgtgggttgtctgtttactctgttgatagtttcttttgctgtgtagaagctctttagtttaattagatcccacttgttaatttttggttttgttacatttgcttttaaggacttagtcatgaattctttctgaaggctgatgtccagaatagtatttcctaggttttcttctgcgattcttctagtttgagattttattgtattgtattgtatttatttagggacggagtctcgctctgttgtcaggctgaagtgcagtggcgcagtgcaatctgggctcactgcaacctccgactccctggctcaagcggttctcctgcctcagcctcccaagtagctgggattacagggatgcgccagcatgcccagctaatttttttgtatttttagtagagacggggtttcaccatgttggccaggatggtgtcaatctcctgacctcgtgatccacctgcttcagcctcccaaagtgctgggattacaggcgtgagccaccgcacctggctgagattttatttttttaaatctttaatccatcttgagttaatttttgtatatagtgaaaggtaggagtccagtttcattcctctggatacggttagccagctatcccagcaccgtttattgagtagggagtcctttccccattttttttttttttgtttactttgttaaagatcagatggctgtaggtatgcggctttatttctgagttctctattctgttctactggtccaagtttctgtttttgtagaagtcccattctctttgggtaactgtagccttatagtatagtttgaagttggttaatatcatgctttattcttttcacttagcattgtttttactcttcagactgttttttagattcatatgaattttaggatagttttttataattctgtgaaaaatgacattgctagtttgataggaatagcattgaatctgtagattgctttaagcagtatgtccattttaatgatattgattcttcctttccattaacatggaatgtttctccatttgtttgtgttatctatggtttctttcagcagtgttttgtagttagccctgtagagatctttcacttctttggttagatgtattcctagatattttattttttgtggttattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctccctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatcaccaagattttataacttgggagaaactgtctaggggtacagggaagacagaggagcctgtccctatatggaaggaataatgttttcaggttggagacatgagtcaagatgcctgtgattaacactgatgcaaatgtacagaaagtaattgcaaaaagaagcgtagtgtgcagattaggggtaaggctaagaatacaggtttggaggtaaaaatagtagttggacaatattgtcccagtgatacttgtagagtgactgaagaggatagagccagaattaggtattcgcctccacaggataagagaagaaagttgaaccaagaaaagatagaaagagcagaagagactgaaacaagaacatgtaaaaacccaaaatagaagtgaggagagaattatatgaaaaggggtgccaccatgttacatattacagataagcaaggaagctcaagaaataatacaaataataatactgaatatatccttcattggaggttaaatgaaataaggttttatatccaatgttctcggtttactttgtaaatactagctcgtggtcccccaaatttactacatgttcccatttttaaaattcagcaaacagatttaggtaacaacagtaaacttactagatatatcttacaatgggagcaactataacaaggtgagtaaaacaaatgaatgggaacgtttgctctggaaaatcaagaaatacacacacacacacacacacacacacacacacacacaatctttaaggatagttattaattatggaagaaacaaacctaaaattatgagagtattaattcatcctatatgataaaaattcttaacattttaaaaaagtcttgcaacactgtaacaaattcaaaaggctggatatttcttcctttaaaattgcttacaagtacaatccagtgaaaattctgtacctttagaaaatgaacagaaatagtcaaaaatttcatctgtgtttcttgtgtgcagccaaatgactagcatccttctctatccactccatattcttcaatcacccataaatagttccaaaaatcatgaagaatagataccactactcagaaggcactggcagatagataggatcaggagtctgctttgacaactacaaggaatttccttaagacatccacatacaaattttaattaataaaattgttattggcgaataaacagaaatggcaacaaggctggcatttgagtagtccaagtattacttagagctccaaagtactaagtgggtgcttgctacatgatggactgaagagcaggtggcatgccaaatgaaatgtccatatttttcacttgcaggaagtagaatattccctgttcaagtcaccaaaatagccctagatttagtcctctggtgaatgaacattgcatactcacatcatttccctctattgaaatgtttcctattaccgtgtccttctatcatcactattgtcatcttttcatccttcaatgacatagtacagattttaagtacccatatgagatttattctcagttctatagaaacagagcaatgggtgaaagaattcatttcagctctaaattctttgtggctacttttccttggcacatttttggagaactggacctctaattaaatgcacctttgatagatcactttagaaagaccattttgaagataaatttctacaatttacctcactacatttatttgcaggttgaatttattagttcaaagataggtcagttattaagggcaagatactattgcttgaagggtcaactgtagtaaatccaattaacttcactgaaaatattctttcgtacatattttcttcagtgagtataaggaaaataaactgtaagaaactgacaattatcctaaaaattaaagaatatgtgaaataaattgtaaaatttgttatttctccatgcaaataaaatgtgacatagaaaagctaaaaaacaaagcaagaaacaactccaaagaaaccacatgagatggaaagatcagaaaatgctactaaaattattagctgtgctgaaaatggcaactaactgctatagtgatattaactgctgtgataatattaacaagctacagttgctaaaacatttattatatgtcaaacactgtgcttttcatacacacatacactcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaatttggtgttcttagaaatagtacaaaaaggaaaaaattcttccttgttttcctttcttgtactcaatttctttaaattttcattttacctactaataaccttagaatatatgattatatatatattaagaatatatatctcaaagcacattataaggaggacataaacaacctttccatgtatgttcaaacatttatttatttatttatttatttatttgctcattcgacaaacatttattcagtgcttactatgtttcactggggtaggaatggggagtgcagacacacaaatatatactacatttagagcaggtcaggtataacaactagtaaagtgcaatgtataatggagcacagagcaggaactgatcacttttgtgtttgatagacaagaaggtcaggacagaaaggctgggagcagaaacagctcatgcacctcattataaggggatggacggcagagagaatgtattccaagagggaacatggaacatgcaaagacaggaagcagaagaagtacggagctatcacgtaggggaatgggaagtaatggagtagaaatagaaagcaaaagccagagaaaagaaggatcttgtataccaccctcagaactgtagtggagaagctacaagagttttaaataagggaatggcacttatgttttccaattgatcttctaaatatatatgaatatatatttataaatgaaggtatatgaatatgtgaataaatagacataagatctactattaatgcttggttttctaatcaaataagctgatctgaatgagatataaatattgctacagaaaaaagaaattcaagataaaaatgacaacttttttgtaaacattaagtgtccattcacttaattttttttaacttttattttaagtacacgtgcaagtttgttacataggtaaacttgtgtcatgagggcctgttgtacagattatgttgtcacccagatattaagcctagtacccattagttattttttctggttctctccctccgcccaacctccaccctctgataggccccattgtgtgttgttcccctgtatgtgtccatgtgttctcatcacttagctcccactcataacttacttacttataaggagtgccttctaccatttggctattttgtcaaccccacaattaacagtttttctatctaatctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaaaaaaaaacttagagatttatggatttcaaaaataatctgtccaaatatacaaagcataatgcagcattgatttttaaactggaaagtgttgtgaaactgtgaagatataatctactaagctgcatacttgaaatgttcaaggccagtgaaagagtgggcataggtgtgaccatcaagtaacatccagaagcctctatggaagctctccaccttaaagtgggggtttcaaagtctttttggcagaattcttttggcaaatgaaatattaccaaaactcttccaaaaaatcacttgagtcattccataaatattgacagattacttattgtctgctaaacattgtttgaggtactagatatgtaacagcgaataaaacagacaaactttttgtgtcctcataaaacttacattctaatggtgataatgtgtagtaaaagagaaattaaggtgctttggagagtgaaaagtgctaaagaacaaaatgtaaagcactggataggaataagagacttaggtatggggcaaagggaggtggcatgtggagagtttagaaagtgcctgcagggaaagcctcactgagtaggtggtatttaaataaagatctgaaggaagtgagggaacgattcaagtagctatctcaggaaagaacaatctgtgcagagacagcaagtgcaaaggccctggggcaggagtgtatgtgtatgttcaattaaaaaaaaaaggacaccagggtgagtggaatctagtgagcaaggggagagtagtaggaatgatagtcatagagttggggatggaggaggataggtcctgcatctttggaaggatcttggctgttatcctgagtgagattaggaagcataggagagttttcagcagaggagtgatgtgatctgacttatttttaaacagatcattctggctgctgtattaagattagactttaagaatgcagagaacagatggcagttaagaacagattcttaagggggtacaatctgcattgtttggatggaaggactttgtgaaaacctgaagccattattttggaaaactttatacatacagttcttaactaagggccaaagctctggtctggtttaatagcagcacaggacactgcttagaagaacattcatttaaactggtactcccaggtcttgctgccttcctaagtccttactggtgaagagtatgggctcttgagtctggttatctaggttccaatcctagcatgaattgactatttccaacagagaccaaatggcccatgaagcctcaaaaactgactgaaatttttctatttggccttttaaagaaaaaagttggccaacactgatgtagagaaacggttaggttcaggctctgtggctctaaaatccttcaagtatgcataattattccacaatgtaaacatatatcaaaacatcacattgtacctcataaatatatgtacttattatttgtcaattaaaataaaataaaaaatacaggggtatttttaataatcaaacattagaaacaaatgcttttctataaactccttatatagactcatagaaagagttaaacaatttataattagaatttatttgtttatttatttactattttgacacagtctcgctctgtcgcccaggctggagtgcagtggcatgatctcggctcactgcaacctctgcctccccagctcaagcggttcttgtgcctcagcctccagagtagctgagattacaggcatgcaccaccaagcctggctaatttttgtgtttttagtacagacggggttttgccatgttggccaggctcgtctcgaactcctggcctcaagtgatccacccatttcggcctctcaaagtgctgggattacaggtgtgagccactgcacctggccaatttgtaattatactttagagcagaggttagcaaacattttctataaaacaccatatagtaaatattttagactttgtgggccaaactcaaattctgccaatgtggcatgaaagtagtcaggtctaatacatgaacaaataaatgtggctgtgttccaataactctttatttctgaaaataggtggaggactaaatgtggcccttggaccatagtttgctgactcttgctttaggatattacagtgttgttggaaataatcagtctagaaataagaacatctgggttctaggcttattagcccatgagttggggcaagtcatttaactgctctaagtttcaggtttcagtatctttaaatataaaataaatgaaactaacagatattactgtgagtaaagggttaaaaacaccctttgtccatctgtatgagaatttgtactttgatcaactttctagctcccttctccctagaaaactgataaagttggaatgtcaaatgtgtgagcaggcaacattgcttcagattaaaaaaaaaaatgatggggactggtaaattacaccttggttaggtgttctacatatgaactataaatacctaatggaaaaccataattgtggggcgtccccaagtacaacaattcttgtaactaagcatgtcctttttgaggaccttggaaactatgttacaaggcattggcctctgggatgcataaggcttctaggccagggttgacccagcatctcgatttgtttccttcctgtgcacctgagatgtcatgagagagtggacaggtgctgcaaagtgaatagctcttggatggctccctgggtgcttcagagattgctacgcatactcatcctactaaagagagatacccgatgctaccttcctgctaagctatattcctatatccttctaagtgcctttgctactgaatgtggtcatagtattgttcagttgcacctaatcaaagaagacttactgttgtgttttacaataatcaattataagactcacattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatgatatgaatgtctttccttcctttctcttatatacaacattgtatgtaatgtcatctgttcatatactctttcagatgcacttttatcacgctatgtctcttaacattcatttgagtgtggttctgatgaattctaaccatcatggcatgtttcagtttctggctgaatgggtcctaatatctctggattatataccccaaaaggattagggaatacagtagatctaaggactagaaaggcacatattaaacaaaagtgattttgacatatctctgaatagtggccagtgatatttgcattattttaaaccaatatagagcatctctaagttattatccatatagtaattggacatggttctttaagtcttaacagaatatttacttaaatctgttattattaaacactagaagttgctttttaaagataaaacagccattaggctaattttcattaaaagcaaagaaaagagcaattcaattctgacttcatgactgacatgcactttaaataaaattaaagatgttttgtttttactattaggttctgtaccaaaatcatagtcattatctaaaacaactctttctaagtgctaccataactaataaactcaagcaatcaaatgggtaattgaattaaactcgtatttttttaaaaaaaaacagcaacaatatatctgcattctctcttctgaatactcttcctaaacatgtacaggaaacagcaaatatatgggtttctgaaatcaagaaaaaggacacattatgtaataaagccaattcctggtttactcaatatgtcagtcttcatctgtgataccaggtctttagactgttgcacttagcctttatacacttataactcatgatttccatatgttccactaagtagccattttcactagtctcctgaaaagtcaacgataagattttggataaggaattgtagacttatatattaggtgcatataatccagaactctactagaatctagaatatacagacaactcatattaatcggtaagagaaagtaaacaatccaacggaaaattggggtaaatatatgaagagtcaactcacagaaggaaaaatctgtccaacaaacttgaaaacttgttcaaccagggatatgcaaattaaaataataaattcctgccacttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaactgccaaatattcattgtgtcaagggggtcaccaaagtgttcagaatttggaaactgtagcttcagatgtattaaacatgcaaactctacttttttatatgtatcattttgaaattacagaacaaactgaatgcatttacactaagtaataattgaagcagttaacttggccctacggtgtttccttttcaaaatatatgtcagatatatacagagaagtgtttaatatcccctatatgcacagatacatatatcatatatatgatatatgaaatatataaggaatttaaattttctatatcatgaatcacatactgattcattcattcagtatgtgaatgcatgagtctaatcccactgacactattgctcaaaggagggtcaggaagaataggggggaaaatgatgtgaataggaaaacagtaagcatatggcaattttgaagtatttggaatacaaagttattataagttgagtacagctgacaaaaaaatgcatagtaacatcagctaactttgcctagtagatgataggggtacttatataaaatagaattgtatttgttaattagaatcataatatactcttcagtgatacagaacttaatatactaagtgaaatctcagtatatagaattgtatattcaagaggacatattgctatggcatttctaagccgtaaattcaacgcataaagtttggatgattacatcttcattggagagaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcatgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgacacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatggaaaatagaaattggaaccttttaatttctattgggtttgtttcttgtatgtcaagaggaatggtattctaactgcaaagaataaaacaaatagcagtgagagggaactggtgtccaagatgggtaaagagattagaaagcccccagctgctcagaattaactctcttgatgcagataaattacatctcagtatgctaatacaactggcaagtcaaatggcaaaccattgtggttactcatgaagactgggaaagtgcagttttgattttcacaaggaaaaataagtgtgggaataaaatgttaagcttccagatagttatttcagatttggctagaaaatgcaatgcaaagagaagccacaaaccttctttaggtaatgtattttgaaagaatgggagtcagttgacacaggctctttgcaaagacaaaccctgttctagccatcaatgtattgttagataaataagaaaatgaaagcaaatatttacatattagttaaaaattttttaaatctctacttgtgctacaatttgtcatcatgttgaacttctgtccaggattgatggctaagaagagcaaagaccattcctatgcaattcaaaggttagttttgatgttttcaggttataaccttaagactagaatctgtctgttgtagaaaacattcattaaaacctttatcatagaaaaccatgtttttacttcaagttgtaaactatatttgccttagtaagaaagagaccaataacccaaaagagaacattggcaaaaaacaaaaaagtagcaaacagtgcatagaaaaggaaataaaaatgattctgcaacacatgaaaaaattcaaattcactcacaaaatgaataaagaattcaaattaaaatgacagatatcaccatttttcttgtttagaagatcaaaaaggttgataacacactgagtgggcacgggtatggggaaaagaaacctttcctaatactgacgagatgttctatgaagagcaatttggcaaaatgtactaacaagacaaatgccagtttgacgcagccattcgacggctaggaatttatcacatagatatatttgcaacgtgtaaaatgatgtgcacaaagttatacattttcttatcttagccaaaagtcgaaacaaactaaaggctcactaattggagtgctgcttaagtgaattatggtatatccttagaacagaatagtatgcaactgtaaaaaaaaaaaaaaagagacagttctttaactactaatacagaaaataatcacctgtgtgtgtgtgtgtgtgtgtgtgtgtgtatatatatacacacacacacacagcattttactcttccctttcttataagggagggagaagagtgctatacacacacacacacacacacacacacacacacacaggcattttagtctttcctttcttatgaaggaggaagaagagtgcttttccttctgccctcgccaagccaaggaaaagggcttcaaaagaaccatcttttgaaggatgcagaaacagtatttatagtattctaacagctggctttattttaagaggacaagagtagaaaataatatacacacacacacacacacacacacacacacctacatcctattcttggaaggctacccaggaaactgaaaaccttggcagcacatggggagagaaactgtgtggctgaaagacaacaatgcaacagaggatttcaatgcttttgaattttgtactggaagaaagtatctattcaataaataaacaaaattattattattattattaaagatggagtcttgctctgtcacccaggctagagtgcagtggtgcaatctcggctcactgcaacctccgcctccaggttcaagggattctcctgcctcagcctcccgagtagctgggattagaggcactcaccaccatgcccagctaatttttgtatttttagtggagacggggtttcatcaccttggccaggctggtctggaactcctgacctcgtgatccacctgcctcagcctcccaaagtgctgggagtacaggtgtgagccattgcgcctggcctatttatattatctttaaagtctgttatacagggataaatttacccccaactttgtaataattaacccagtatgacatcactgatacagtactaattaactcattttctataaaactgtgcagattatcttaaaattcgaaacaaaaatgaagtacaatacaaatgataacaacagttccagaaaacaacacttaagcataccacacgtaacacaatgtaataacctgcgttatattctttggtaccctatgctatcttattctattttattttacccattaaatggatttcataactcatcagtgggttgtaagattctctcccgggcctgaaagcttaaggagatgagtaactcctcctttctcaggcccattcctaaggcacaaggctacttgcctgagcagcatgcaccggcgaaatagcagaagcaggaagagagccggccagaagacaagtacctctgaagatcgagaaagaggccatccgggtacaatgcagcagttacgtcaggccaggagacttcctgtttacaggagactataaaacctttgtccagtcctcacttggggctaacgccattttaggcctgaggctgcccgcacccaggcgctcattaaaacagcatgttgcggccgggtgaggtggctcacgcctgtaatcccagcactctgggaggccgaggcgggcagatcatgaggtcaggagatcgagaccatcctggctaacatggtgaaaccccgcctctactaaaaatacacaaaattagccgggcgtggtggcgggcgcctgtagtcccagctgctcgggaggatgacgcaggagaatggcgtgaacccaggaggcggagcttgcagtgagctgagatcacgccactgcactccagcctgggcgactgagcaagactccgtctcaaacaaacaaacaaaaaaaagatttgactggatttgttcctgtggtaggcacttcattccaattttcttgcccactttttggttaatgacagactttcttccgctttacaaaataaaagcacacctctctgacctatcccactggtgcattgtagtcaagatacatttatgccaaataaaagtacaattcaaaatattagcgactgaaatccttctttactcaaggtaccatcaaatacccatccatctcataatagattcattttcaataactatccactgagtatgtttaataattatttatcaaaaggtacatatatttaggttatttggttattactaagtgtatttattattaatactttaaatactactcaatctagagaattttaaaaatacttagagccttgtagtcacaggaaattgtttttaaaaattgaatttaagtccacataaatataattttataaagaattatgatagagtggctaataaaactttatagcataaatatgtatcacatatttatcacattagaatacaattcattggggaagttgaaaaatatgatttaaataaaaaggaataatataaaacttctatttattaaatatgagctttttcatgtatttttaagtatatgatggtagacattatattgcaatggtatttggattccacgggatacattctaaactgtactataaacccttttaaaatgtcaatatttactgtatcccaagggcagaaaatagatgtcatctttaaaatgtgcaagcagatattcaattttctaaaatatttttattttttataaatacaatggtctgaatgccactataatagaggttctttgaagccctcttccttggcttggcaaagaggaaaagcactcttctcccctccctcataagaaagggaacagtaaaagtcatagaagttttctcatgtccaacaaattgttagtcctatttgaatgatctgttccaggaattctcattcaagaaactgttctcaagtttatccttttccttatatgggcaagttaggttggtgaacgatgaaaatctcatgaccatctactcccttttttggagtgtttttctggtaccaacttgctgctgtaggggtattttgaaggccttttttttttttttttttttttttaaagaagtcttgctctattccccatgccggagtgcagtggtgtgatcttggctcactgcaacctccgcctcctgggttcaagcaattctcatgcctcagcctcccaggtagctgggactacaggtgcgtgccaccatgcctggctaattttttctatttttagtagagatggggttttgctatattgcccaggctgatctcaaactcccaagctcaggcaatccacctgctttggcctcccaaagtcctagggttacagacgtgagctaccatgcctggctgaaagcctaatttttattgttagtacctcttaccataactcctgatacaacaagaaaggtcccattcactgtctttttctacgccttaggaaatgtgttcccatcttagttttgccttatctaacagagtcccagggaaattcactcaatttttcatttttagtgaagaagaaggtcaggttaaaaagggtaagtgagttaaacaatatcgtaaagccagtaagtgtcagcactgggattcaaacttagtcttttgtttctttccccttattattctacttcaactcagcaatggtttttggagttgagtagaaaaaacaaaaagtaagaggaagattatggtacccagtgttcataaagagaagcagatgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaagtgatgaatactctaataaagacagacacaatacactacaaagtcatggagtctggagggcctctgtctcctggagaaagaatggagagacaggaggcaggagagaaggatgatttcacagaggatatctcatttgaattttctgttaattaatgggtaaactatcgaaagctattctgcgcagcccattaaaaggtactctgttggctcaagcttgacagtgtgtgaggaagaagaaagagatcttatgactagggttgccttataaaatacaggataccatttacattttgtataagcaatcgatacttttcagtattttttgttgtagtatttgggacatagttatgcttagaattctggatgtttcatatttttatttgctaattcttgggatcctagttatgactggaatgtggaagaaaacaataccagctgaatatgatttgaagagttttgtgtgccatgacatggagttttgaacttattctacagggataaacacttttgaaaagagtttatacaaagttgactttagaaggattagagtcaaagggggacttgaaaccattaagaagtcaagccccagtaatggcatgaacagagctcattctgctttccaaatatctaatctgcagtagatacttagtggctggaatcacctctgacatggctgacctgtgacagctatttcatctgcacattgccaatatctctgtgcttaggagattctctaaagcgcggcataatttttcttggatttcccctttcctgtttcattaaccctattctttcactcttacatttgaggatgaacttctctgcttccaatttcttgtcttacattctgttcttgagtgtatttaaactaacactttatccttttccatttcttccaaaaagtaaggataaatggtccttgatttatttgcaagctacttctttccctgaaaaagtttgggtgatccttagcatcagggtttagtatgactaaaagaaaaatatgtattagttattgtacaagataacttgaatgatcttttaaattttacagttcatatgtgaaagaaacttggcagggtcttcctaaattggacaataaattgtaataatttatgtgacatcaccaataataagttgaaaatgtaaaataaacttttctaaactatcaatgatagaagtcaaattttaatcaacaatgctgggggaaagagtaaattattttctgatgctctcacatgaagaggtgctgaaagaggatgcatccagaaagatagaaaaaattatttcagacactgtatattctagtattgcagagatggttcattattaagaaaacattctgcttatttttttcaatttttgtgatgtatgtggttatctgtcatctttttaaaaacgtataatttgttatgatttcctttctttctataatcatgttcatacctaattttatatttgtcctgttatattctttgacttaaagaaaactgccaaattagaatgtgcttcaagtttcagaaaaccagatctacctctgcttattcttttacctttattgagtatagaaaaccatttcattcagtatcctaaaataactaatttggtataggcattgcaaatctcttcttttactttgaagaccccatcgtttctaacagatgtaaaaacaaaaagaaaacaaaaataaaaaatgattttatctgacttataagtagtacattaaaactagttgagtttttgatctaaaatttaaaaataattagccgagtttctgatagaacaacattttacaatttctttgcttttttcttttttttttcttttattattgtactttaagttttagggtacatgtgcacattgtgcaggttagttacatatgtatacatgtgccatgctggcgcgctgcacccactaacttgtcatctagcattgggtatatctcccaatgctatccctccccccttcccccaccccacaacagtccccagagtgtgatgttccccttcctgtgtccatgtgttctcattgttcaattcccacctatgagtgagaacatgcggtgtttggttttttgttcttgcgacagtttactgagaacgatgatttccaatttcacccatgtgcctacaaaggacatgaactcatccttttttatggctgcatagtattgcatggtgtatatgtgccacattttcttaatccagtctatcattgttggacatttgggttggttccaagtctttgctattgtgaatagcgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttatcagatgagtaggttgcgaaaattttctcccattttgtaggttgcctgttcactctgatggtagtttcttttgctgtgcagaagctccttagtttaattagatcccatttgtcaattttggcttttgttgccattggttttggtgttttagacatgaagtccttgcccatgcctatgtcctgaatggtaatgcctcaagagaataaaatgcctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatatctacaactatctgatctttgacaaacctgagaaaaacaagcaatggggaaaggattccctatttaataaacggtgctgggaaaattggctagccatacgtagaaagctgaaactggatcccttccttacaccttatacaaaaatcaattcaagatggattaaagacttaaacgttagacctaaaaccataaaaaccctagaagataacctaggcattacaatttcttttcttaaggaatgatggtttgagtaatcctttagggttttaccctttacatgccattaaattgtcataattaatcatcatgcaacaggttgtaacatgtaaagtgacaatttagaggctgatacagaagaatagcgaataacaggggtttagtttttatgcatcatttcttcaggaaaacacatcatgaggggaaatagctttgaataagttcagtgaaggttgccatttagttaattaacttaaccattttcattagcagactcagtattgactttagaatactgtctgcttaatttcttccaaacaatgaatatgtatgaaacaccaccaaaggtaaagtgaaaatgaagacaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaacttaattcttaaaaatgagtccctcccctgtgagtggattatcagtatttgttgtatgtgcatatggggaaaggttacgctacccatgctcctctagacattctggtatattctcccatgtagacatacaaggcagagccaaggccttcctttatgaaccatttactgggggaaaataatgtatcggatcactttactccctgatatggactaatgctagaagcagttgaatctactgtctttaatgggacagagttgtgctcaaggatcattaaccacaaccaccgcccttactcagagataaagatttaagatctcttagcatggtggctaaaggttttcaaactcttgcccaaacataccttttcaatgtcaaacacaatcaccttgctctattcaggaggaatcctaccataatattttgtttacagtctctccacctataataatctttcctcttctcttgagtactgcaaattctacttcagaatagaacaatgtctacatgagggccttcttttgtggtccaaggccattttgcttctgctatagtttatttgagaaaataattgtctgtccttgggcaactcctgtactaccgtcctttgttgcaatctcaactttccacataattactttccaagctatactacgaggcaaagggaggattatgaagggtttagggttactctctcttccgcttcactgtaatttctattctttatttagaaacattctgtctattcctttattattttgtagtctataataatcatacaacatcttattaatatgacactatattttggatatgccctctattatattactaatatttacataaatgtaaacatttttatttccatgatcctagtgacttttaccgtttctaatgtatttatttttaaattaacacataacattgtatgtatttattgtgtacaacatgttttgaaatatgcatacactgtggaatggctaaattgagataattaacatatgcattaccccacattcttatcatttttttatggtgagaatgtttaaaatgtaatctcttggcaattttcaagaatacaatgcattgttattaactatagtaatctccattccttttaggtatctgcttaggctggtatcatacacataataaatgttcaattatttatggaatgaacaaacccaatgttttatttctttaatgaattagttcattctgaaaactaatacttctgtcaatcaacaacaatcaatcaaccaacttcaaagtaacttctcttcgttagagatgactagcagccttagtatcaaattggtgattattaagacggacaacatgataaaatattcaccccataactcccgctctccaaagtgaattctttaaatctcttttgatatgcaaagttcagtgagaagtgaacaccttctgtcacctagcaacgtgctgatcttaaacaaggccagttaacctcgctgaacctggatttctctttctgaacaaagaaagacaagatccacctcctataacttctgtgactcaaatgagctaatgtataggaaatactgtgcaacatatagtggtttataaaccataaaattctgaaaaaattagctgattgaaccagtgagtagagcgtaggcaaagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgattttttcccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaattttaatgttatattttctttaacttaaatagccaaattgttgtcacttcaacctgtactcaatataaaaagtaccaatgagatattttatttttttcatacttaggttttgtaatttggtgagtgttttatacttacagcacatttcagtggggactagccatatttcaaatgctcatatggtaggctgttgttaccacattggagagcactgatctcaaaggaaagttggacatttcgtccaagtttttgttcaaataaaaaactgattaaactttgagcaaatatgaattattcttatcagtctcttattgtttcttcctctcaaaaatattcgcaatattataaaaccagcaatgttaaacatactgaactcaccatttgaaaaagatggaagataagaatcattttcacaataaatgctgtaccatactatccccacaccaaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacgtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtactttttgaaatatgaaggaataaattcaatttcttaatatattactacacttaacagattatgacaaatacttctctaattatacaaaaaaattaggtttggagaatcccagagtattagctgcattttcaaatgccagcaggtgaagggaaataatccgtggtgggaagactctaaaatggcactcagtgatctctgtctcctagtatttgagtcctttaataatttcctccccttgagagtggtcaagacttttgacttgcttctgacaagcagaatatgtcaaagacaaaaggatatcacttctccaattaggctacataagattgggacttttgtcttgctagcaatttcactctttctctgtctctttcccccctcccccactttctctcactgattttgatgaggcaaattgccatgttagagaccgaaggaactaaacgtggccatcagccaacaagaaaaggaagactacagtccaataacccacatggaactgaaacttaccaacaacaggtgagtttggaagcaggtccttccaaggcaagctttcaaatgagaccctagccctggccaacacctagtgtgcagcctttgtgagagaccccgaagcaaagaatatggataatctatgcctagacttctgacccatatgtatcctgatactctaaagatacagttttaagcccctatctttgtagtaattgttatgcagcaatagacaactaatacataatattataatctttttaagaaacaaatatagtaacataaaaattaaataatggtgaagttgtagggttttcagtataggagtattgcaaatataagaacggaccatattttaacgagttactgaaaaatagtggcgaattttaaagtttcaatgtcagaaagaagaaatcaaatatatactcagatgaaatgataaaaccattaaggtttcatgcaccctctcacatttctaacattaattttcaaattttaagtagaacagtgataaagatgaataatattgtcaatcttctagttttattttagcaccttgcatttaaaacagacaatttatctttgagttgttggtacttcaaatagtttttttaaagtttccacaatttcacacagagacgaatgctaagaatctgttaagcttgcttttagggaaaaggatgcctcaaagtcacaaaactttttaaacttggttctttgggggtgaaaaagcaggcatatttttcaccaattttctaaattttacatgttaaattggaagtaagatttatgttaaactgtttattaaaacatattaaagataaaccatgtgagagaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatagcatgaaaatagagatgtagtgtactaacatgtaatatagagttgatgaagacatgttggaattaacttctgaaaattgttgatgaatgcacagtttagaaatgacgaataatagttctattccatttccatttaaaggataaaggcttcaaaatgcatgaaaaattataaagtgaatttttaaatggttcatgaaatctcagctttctgaaactaaattagcttcttttgtttttcagattcgaaactctatgatatggtttggctgtgtctgtaccaaaagctcatcttaagctgttgttcccataacccccacacgtcctgggagggatcaggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatgatctccttgtaagtacctgagtactgaagccaactgtcttgatttgggtctcccagtagcaaacccagaaataaaaatttgagctcaagtagttttgggatgtgattccaggacacatcaacagggtgagaagaagtgaaatagggaagatagccaataaagggtatattatcatgcaagtcatcaatgtgaacaactgaatcttaatactccctgttatccctaaaagaagatgtaggaaactaaggctactgtaaccaaaacagcatggtactggtaccaaaacagagatatagaccaatggaacagaacggaagcctcagaaataataccacacatctacaactatctgatctttgacaaacctgacaaaaaacaagaaatggggaaaggattccctatttaataaatggtgctgggaaaactggctagccatatgtagaaagctgaaactggatcccttccttacaccttatacaaaaattaattaattcaagatggattaaagacttacatgttagacctaaaaccataaaaccctagaagaaaacctaggcaataccattcaggacaaaggcatgggcaaggacttcatgatgaaaacaccaaaagcaatggcaacagaagccaaaattgacaaatgggatctaattaaacgaaagagcttctgcacagcaaaagaaagtaccatcagagtgaacaagcaacctacataatgggagaaaatttttgcaatctacccatctgacaaagggctaatatcgagaatctacaaagaacttaaacaaatttacaagaaaaaaaccaacctcatcgaaaagtcggccaaggataggaacagacacttctcaaaagaagacatttatgcagctaacagacacatgaaaaaatgctcatcatcactggtcatcagagaaatgcaaatcaaaaccacaatgagataccatctcactccagttagaatggtgatcattaaaaagtcaggaaacaacagatgctggagaggatgtggagaaacaggaacactttcacaccgttggtgggactgtaaactagttcaaccattgtggaagacagtgtggcgattcctcaaggatctagaactagaaataccatttgacccggccatcccattactgggtatatacccaaaggattataaatcatgctgctataaagacacatgcacacgtatgtttattgcggcactattcacaatagcaaagacttggaaccaacccaaatgtccatcagtgatagactggattaagaaaatgtggcacatacacaccatggaatactacgcaaccataaaaaaggatgagttgtttatgtcctttgaagggacatggatgaagctggaaaccaacattctgagcaaactatcacaaggacagaaaaccaaacaccgcatgtcctcactcataggtgggaattgaacaatgaaaacacttggacacagcgcaggcaacatcacacactggggcctgtcgtggggtggggggctggggagggatagcattaggagaaatagctaatgtaaatgacgagttaatgggtgcagcacaccagcatggcccacgcatacctatgtaacaaacctgcacgttgtgcacatgtaccctagaacttcaagtatatatatatacttatatatatacttatatgaaagatgtagggaattaagcttggagttattagatctgaagggcaagggggacagggtattgatctatcaactgctgctctacaggggcataactgctacatttctgctctctcccaagaatgagcagagatagccccaagcaaagagatgcaagtacaggaagttggaaattaagaagcacgtataaaaatggtaagtgctaaagggatatcggtggggcaccgacagtatctgctacaacacctcatacattttttccttaaatgatctccacaacctgcctacatttggaaagtattgttgtaatgtcaaaattaccattcagtttcattaattgactaaaaaatcaagtcaaagcaatgtgacagatattggttggttatcttttcctaattcatctatctattctgtctacctgtctgtttatcagtcaatcatctttcacccttacgttcctttgaggaactttgcacctacttctctacctttgttgtggtgcagctgtagagtttggttgagatttaatgacttttagctgtagaagtgaggtgtgatttagtacaggaatgagcatgtgacctaattcaggccagtcagtttcagagcagtctttcctggatgctttgggaaagaaggtccctaaagagatgattttcatcaaaagtaagtttgcagatgtgggttctgaaacggcttcaggccatttttgtcaccaagagggaagtcaggtgaagctgctaggtcaacacagaaaaatagaacccagagaaatgtgaaaaaaaaaaaaaaaaaacaagaaacaaaaaaccggaaccttgatcatatttattgtttaaatcagtttgagaccagttttctgtcacttacagcattaagagaaccaatagacgcattaagtcagttacttacaggcatattagttagaactaatcctccatgacacttcacagaaggtgaagattcatgcatttttaaaataattcattctatcattttacttgaatatcataaaaatctctcggttagtgttaacaaataatagttttctttcgtttttctaacacctaaaaccatatttcataatcccataatgtgaaatagtgtgaataatatgtaacagttcaaacattatgttccagaagagagagatttttattttttctttctattttttgaactccagagagagatttttaaatttgcagtttgagattagagctttccaacagctgaagtgtttactattttgagagaagacttgcgaaagcaaaggttaacctagtagtacctgctgtgccttcgttggcaaatgaaggaaaatcacacagatggtggcatttgcctgggagttgggtgccaggggtgtcctctcaaaggcacacaaaaagatagaatgaaatgtctctcttttcttaaatatgtggatgtggatttgttggaaaaaattactttacccacacttgaaaagtcatcaccactgtcaccaccaccacaatcaatcaatttaatagtgaacatgtattaatcctttagtatgtaccacattctcccttgccaggcaagcaaggaattcagctttgttctagactgctgtttggcacagtcttaggttattctccttctaacagtgcaaagcacttagaatacagtcgatacacagtaagttattaataaatattaactatcattacctaacacactgaggaatctttaactctcccaaggagtggggaggacttcaaaacaggaatcagttaaatttctccttggaccgtctagtgcaggcttggtgtagatataaaaagaaataaaatattggtacaaactaaatgcctgacacatctgaggtagaaactaacgaacgttgtaagtgaaatactgctgtgggctgaggataacaggaggccaagatggatcttgtttggagatgacaaggcaggctctatgggattagaaaggagaagtcagatttagagattggtggtattaagagagaaggaaaaaaggtagactttctaagtggaccaggcagggaatcagaggcgaggaagaaaacagaacaaatggaaagaacattgggtagtctcattttgatggcagcctgagtgaaaatgaccagtgggagaaaatatcagaagatttctatagctgaatgacacaggggttggaaacccagggctaaaggagaaatttatcaaggaactgtttcccttactaaatccacagcatcgcccacataggtacagacttgtttgtctaggattttgtgactacatggcagtttgccttatcaaagtgagtgaaaggatggggaaaagggaaagcaagacaggaagagaaaaagaaatagggagagtgaggctcttgtcacaatcaacttgtaattgctgaacagtgtgttggtgctttcatgtcagaggtaacatttacagaaatgacacattttaaggccctgaggggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcactttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcgaagctgatcctcttacaactacacgagaagttgccgaggaactcaatgtcaaccatttcacagttgttcagcatttgaagcaaattggaaaggcgaaaaaactcgataagtgggtgcctcataagcagagcgaaaataaaagtatcgtcattttgaagtgccatcttctcttattctacgccaacaacaacaaaccatttcttgatcggattgtaacgtgcaacaaaaagtggattttaaacgacaactggcgatgcccagttcagtggctggactgagaagaagctccaaagcactttccaaagccaaacttgtaccaaaagtcatggtcactgttcactggtctcctgctggcctgacccactaccgctttctgaatcccggcgaaaccactacatttgagaagtatgctcagtaaattgatgagatacatcaaaaactgccatgcctgcagccagcagtggtcaacagaaagggcccaattcttctctgtgacaacgcccgaccgcacgtcgcacaaccaacgcttcacaagttgaatgaatcgggctaggaagttttgcctcatctgccatatttacctgacctctcaaccaactgactaccacttcttcaagcatctcgacaactttttacagggaaaatgcttccacaactagcaggatgaagaaaatgctttccaagagttcattgaatcccaaagcatgaatttttatgctacaggaataaacacacttatttcttcttggcaaaaatgtgttgactgtaacggttcctactttgattaataaagatgtgcttgagcctagttataatgatttaaaattcacggtcccaaactgcaatttcttttgcaccaacctaatatatctcagtccatttttgtagggccatttttgttcctgtttccaggtgagaaaactgagaccacagagagatgacacagctagtaaggaatttgtggaaggcgattatttggcagccccacaattaatcacgcctcttggattcatgcctttgtgtagtcccttctcattttgattctgaacttggccatatgcctggctttggccaatgggatagtagcaagtgtgatacaaacagaagcttgataagtctttgaagattggtgcttgttcttttggaaggcttcttcacagaactcaaccaccaagctgtggggaagccaaaggagacacatggagaagacaatggaaacaaactgaggctcatggccaatagctttagctgagttctcagctggtaggcagcaccaactgccagtcatgtgagtgaggccattttggactttccagctttcccagtgtcttggttgatatcaggtgaagcagatgaatatcatagtcaactctcagaattatgagaaatcgtaaaactatcttattttaagccagtaacttttagagtggtttgttgcatagcatatataactggaacagagtgaaatcaaaatttgaaccaggcagagtagtaacatgtcgaactaactatacaggattaaaaaaaacagcttctcaaagtgaagcagaactttatctttatttgttttttgaaataaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaaggaaaaccttgcacactgttggtaggaatataaattagtacaaccactatagagaacagtttggaggttcctcaaaaaagtaaaaatagagcttccctatgatccagcaatcccactgctgggtatatacccaaagaaaggaaatcagtatattgacgaaatatctgcattcccatgtttattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggatagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaaaaaattttaaaaagagagaattggttgtggtaggagcagatagcataactttcactttataggtcactggaccatgaggaaccatatcttgatctgatggagaagacagtgcatcatccacagacaatggacttttagctggatgcagtaagtgaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacggctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaatacataggaatgcatcttaactgaataccttacttgtgagggggtgagaaacttaatagattgcaaggtgtggtagattgcactggtgacctctctgtatgcacatctttttgcaatgtgacttttaaagttgctaccatcaggagttgtaacctatttccctaatccctgaatatgggcctgccttgtgatttgctttggttaaaaaaatgtgttagaaatgagtgagccagctccaagcttaagcttcaagaagtcttgtttccttctctattagaatcctgtttcttgcatgagaataagcccaggagcgcttgccgaaggatgagagaccatatggagcagaggtgaatcatcctagctgcgcttatgctagataagccagcccctagcccacccattagctgactgaaaatgtatgagtgagccagaacaacacaacagctcacgggaccccacagactgtgtgcaattataaatggtgataattttaagtcaataagttttagggtgatttgttacataacactattgcaaattttacactattggagttattacttaactgatatataggggaaagccagaaatgggagtgaggcttggtacagttaagagttcttaaataataccagagtcctcaatcctaaaattactgattttgattttgaatgagtatctaaagtcaggctcaattctttgcaaagatgtctgaagagacattcatggcaaatcaatgggggtaaccactgaaaaagtgattttagaagatcattattagaagacctaataatagctagtattttttggccacttactctgtatcagctgttgcccaaagcagtgaaagagggaaagaaataccctgaaatctccccttctcctgctctccaatctcctgccaacgcctcccactggttaaatctatacagaagatagttgagaagaaagcctgaggaataaggtgagtggaggtgagcttcttgcaatatacaatatattgcacagaaagaggaaggaaattgagtgaatctgtgggaaagttatacttgggttatgaaccccacaacgatctatgtttcaaaggtataaatcatttgaatgtgttcatattttctgtcaaagttgatatgtatcttctgtggtcggatgaatgtgcttcataaatatcaagagacaaaatctttttgcaaaggcctttccagtatctcagaacacactgtatgcattccattgaatgggattggtggtcaactcctacacagactcttgatagccactctctacctccctaccatttaagaagtagagcaaggggaccagggaaccagcatcttgaaattagggggggaaatgcagaacctcaggtcctatgcaagagccattgaatcagtaacctgattttaacaagatctcaaggtgattcctgtttcagtaagtcatcaattaatgttgttgatagattctgggaaactgtgacttaggcaaaatgacatataatgaaaccaatcttaccataggctaattgataaacaagaattaagttcctactgcatacctgtgttcacaaaacatgatccaacatctaaataaagaccccaagcacttctaatattaaactcagaaataaatgtgagatatacatccactttagaaagattaataaaaaccaggaggaaaattatttacccagtttttggtgaatcagtgagtgacagtgtttgcagtggcggtggttcattcaaggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcgcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgctattagaattttatggtaacctactttgtaatagtaaccacaatttaactcctcgtaataaagtatgatagtatatattgtgtttttagttcctcactagacgctgggagatgggcaaacatgcttcataatgcatcactgttggacaaatgaggaactagaggcactaagagatttaaataagtggcccacagttatgagttagtgagtgttgaacctgggtctagactgagttatgaactgcaagtttagtgatctttccaggactgagatgaggcatggagaataagaaggtggaacggtggcactcattacacaaaccattagaatatttgaggccacgttgggaattaaccacacgcgaactgagaagctggaaaggggtatctttaagaaaactaatccttcacccgaagtagaaatgattatttaatcatactgcattctagtttcagcataaagacttgaacatgttaatgtcaacatctttttttttaatctttttttttttgtttgtttgagacagagtctcactcggttgcccaggctggaatgcagtggcgtgatctcctttcactgcaacctccgcctcctgggttcaaatgattctcctgcctcagcctcccaagtagctgtgattcaagtcatgtgccaccacgcccagctaatttttgtatttttagtagagacagggtttgacaatgttggccaggctggtcttgaactctgacctcaagtggcctgccctccttggcctcccaaagtgctgggattacaggcgtgagccaccgtgcccagcctcaacatctttcttaattattttagtaattaaaatagtttttgtctgctcccaaactatatgaaatcttacccatagagtgtcttttctattaattttcctgttttgtgtgttggcctttatttgttctcaatgaataagggcctatatagcacctgaatattaatttttttctcttccttaaccagcagctcagtgattctaacatcactgataaaatacacatcactgatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaaccatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaatttctccatcaggcccttatcagcccttttgttacccatacagtggtcttgccccgaaccataaggtggataaatgaggggaatgctgattttggcatccagcttactttcagataatctagctcatccttctcagctgacacgagacagaaataacatcaaagggtgataaactctttcttgcaaacctggggttccatggttcactggccccaggcctaatccaacaatccattttctacacaataaaaggtaagaaacccattacagatctgttataagccttggcaggtggtatacggcaaaaatggaatacacaaccaacccagcatttggtatcccttttctatggtttgaagcactaggggtcagctgacatgaatatagtagtcagcatttagtattaagttattttagctacataaataaactcacatcttgatgtatgagtataaagatttgacagaaaagttcatttttggtatgattctgatctttaataaaaatcaccctgttattttacttttgtatggcatattggctttgcaggtgatataataaatgaaactgggttagaatttacaatatgtggtcttaaatatggcctttaatctttgttccttatttaacctcagtttaaggagttggcatatgaaaacttccatttaatatcatttcacgattattaaattattagaaaggaaggaaactccctctagtctcagggttggtgctatgtaagtaaaagcattgcagaaacaaaaggaaagaaaaaacattttatattagcaaaatccccttttattatgtcatttcttctcctttctagaagtcattgcttcaggcaaacacctttgtgctaataaaggagttacttaaaaatgctacactgaagatgcagagttatgaaatttttctcctcctttctcttttcatcatcatttatactcttcatcattttaaatccatcatgaacggggaggagagattgctaagaatagtcgaatttgtttttagttgaaaattagcttaacttttaaataaaatctagggcacagcatacttaagtgacacatttacatgcttgatatacattttcagtatgtagatagtggcaacaatgaagtttcactatggaaattagttgttacacaagtatcagtgcttcacaatttatgctggatttttgttatattttttaaaacattattatattggaatgaacaaattatcttgtatttggtgaggtttcctaatagaaaattatctagcttcagtgtaaccttctacaaatgcttttcctttactttgccaaaatgagggaaactgatgtcaaaaataaaggtagggggaagggatggggaagcagtgtgaaagtttacttgctttctgcttggatttctgggttacaatcaggccaatagattgataaaaacgatgttcagaattaaaagtcctctgaattatgttcatactttaaaagtgagaatgctggtgtttgaaaacaatgctggctttgttgggcttcttaggcaataggaggagaaaaatctatcattttccaacacattttagctgaaatgctagttggtcatagaaaatgaaagtaatatcagcggaataggagagcagtggctgaaaatcctctgtgccttccacgagagccatttggttgtcttgctgcctctaactctcctctccttcacctgttgcattcataatagtagcacatagttcagctttctccccaagagccatatttacaactttgattaagaaggtgagacttttggagaatttggaggtgagaatcagagatgattttgtgcttgctctttgcatttttctattttagtattactcctactgtttttaatctaacattttttgagcaattacaatatgccagatactgtgttacacatttcccatttactacctcattgaattttcaccacaacctggggaagtgtcttcttttagtatttgaattttatggatgttataacttaggtatggacagagtaggtataagatcacatagctggtagcaagtggaatccataattcataatctcatcattaatgcctgcagtaaattacctcctcatcactcctgtttactttttccttgtttgtaaagtgtctgatccatattcttggcattgcctatatggtattatagtacatactggtttctatccaggttcctggctcataacacccatagcccttgttacagttttttgttataatgttggttgcgttgggtctcaggggcaggcctctgaccttctcctgctctcctttcactttaatgttccctcgcctttcagattataggtcttaaaaacctcctgttagagggtcccaccatatacccttggggaaggaatgctgatgtcatgaagcttccataaaaaacaaagaggacagagtccagtgagcttccgggtagctgaacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgtgcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatatactattgtcattaaagagtgattaattcggtaataatggcaatcagatttcttggataggccgaaattctcagctgaactaaagtattaggaaggtagatgatgatgacaaggacgatgatgctactaagaacaaaagcaatcatgataataatagttattgagcactggaccaagcctagctctaaaagcctgatgtttgttctcataactagagtgaccctctctatatattttatcttctaaagtggaatacttatgacaatgaaagagggagctattaaaaattatgataggataacaggcaaaaaccagaacagtcagagcaaattgagatgtactcatgacacacaacctagtaataaacctcatgtcagtgtgaaattataggaggcaaagtcaaggatgcttatgttataaactttaaattactactcccttcccccaaccctcagcttcaaactgtttagcaactataaattagagatatgaatatttataatgccaagccctataaaattatgcatgtcctttaaataagggaagggtgggaagtgattatgatatgcttagaacagaatgtggcacatagtagtcctttaatagatagctcttgaataaataatttaattacagctttgctgtaattattaactacataaagaaaacatccaaataatggatttccaggaacttacataaagaaaacattcaagataatgggtttctgggaactatcagactatatgcccaataaataggtgaacacccttttttttttttttttttttttgagatagagtcttgctctgtcgccaggctggagtatagcggcatgatcttggctcactgcaacctcctactccctggttcaagtgattctcctgcctcagcctcccaaatagctgggattacagacacatgccaccacgctcagctaatttttgtatttttaatagagacggagttttgccatgttggctgggatggtctcgatctcctgaccttgtgatctgcccgcctgggcctcccaaagtgctgggattacaggcgtgagccaccacacccggcccgttttcttatataatagcgttttagcacacagatttataaaattaaaaactgtgtgaactgtgttacaaatacacttcaagggagaaaatcatgagcacataaaagctccagtggaactatctggtccctgctaagacttccagctagagaaatgatttcctataatgattattatacttcctactatatattttacagcatttttttttccggggttccataaataccagtcaatatggtaacaatgccagtgaagattctattatttggttgaaaaaacatcacgttaagggcaggactgaatggtaactattagaacaatctattaatcgtcatcttgtgataggaaattgattggacaaagtgtccatttttgagcaaggagtcggaaagccaagctctagctttatttaattttctcctttttgctattcacatttatactgacgactaataatgactgtcattacatagcaaatacgtctggaaaaagactaaacattcatttaccttatacaaatgaaaataaatctgaaatgtttactcctcagatacatatttagaagcaacatgattagagattaatacaaaatgaaccagatttctggaaatttagatacagccaactgtatattgtggaagatagtttgtgctaggagttgcactgtatttttactttcataatttttatttggtgattttttgaaaataatacctgtattattatcaatattacaaaaattattcccatattaaaggtttgttatatatgttgtatttgtaaacctacctttttcctcggtaaagtgaataagatgcacttaactaaaattcactttccagccaaatttcttaattgttttccaaaatgcttttttctttatgtgcaccattttatactgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaaggttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagttaaaaaaatacccacatataacatatacaaagagcaatgaagaatgaggaaaggggacacaaaataaaaagacatgaaagagatgaaactgggattaacggggtcagggaaggagagcagaagagaatgtgttacataaacaactggggcagaaaaagagtggcaaatatgcaaatagaaaagtagattcatggccaggtgcggtggctcacgcctgtaatatcagcaatttgggaggccgaggtgggcagatcacctgaggtcgggagtttaagaccagcctgatcaacgtggtgaaaccccgtctctacttaaaatacaaaaattagccaggcgtggtggtgcatgcctgtaatcccagctactcgggaagctgaggcaggagaatcgcttgaacccaggagacagaggttgcagtgagtggagatcgtgccattgcactccagcctgggcgacagagcaaaactctgtctcaaaaaaaaaaaaaaaacaaaaagaagattcctaataaatatataaaaataaattcctataatatacgtgtcaattcatagatgaaaattagcctaaaagtgagaaacacagaggaagagagtgatgatgatggcgagagagcctcctacacccacatgcatgttcagagaaaatacaaagaaatatgaagagggataaatattaaaaacacctgagtcagaagtgtgggtgaagatcatagaatgagatgatcagagagaggaacacagaggctagctttaataacatccccactttgtggctcttacgggtatcattgttaaaggctgtaaaaggtcaagttatgtattagacaagaatgaggatatcatttcatgagccttcattgcatgaagctacccataaatttacgctaatggctatattcagtttaaagcaaccctgtccaccactcccttaaagaaatagctatattatcttcacctgctgttttctctcttcagtaatgaaatataaatgtacaggccgggcgcggtggctcacacctgtaatccccgcactttcggaggctgaggtgagcagatcatgaggtcaggagttcgagaccagcctggccgacatggcgaaccctccatctctactaaaaatacaaaaattagttgggtgtggtggtgcgcgcctgtagtcccagctactcgagaggctgaggcagaagaatcacttgaacccgggaggtggaggttgcagtgagctgagatcgtgccactgcactgcagcctggatgacaaagcgagactctgtctcaaaaaataaataaaaaaaaaaataaaataaaggtacaagagtaaggggtcagttggctcaatacgcagaatgcagcatattagagttagctgtggagaaagtcacctgccaactgattatgatattaggatatgtttggagatactatgtactaaggaattgacatattcatgtcacagtaactatgacccactagttccaattatatcacccactctaacctttggatgaagggtagggctggaggacacagggagggggtccgctttatttctaccctcctgtaataagtaagagcttgagatttaatgaagatcaagactgtctgccagtgttataagccattttcttttacttttaaaaaaacttgtgttatttacctaaatctggtactgatcatttgctttctatccctaaatctaaactaacagggatacagaggcatatggatggagaaaagatgattaaataattttaatatgactaatgaataaaattccaaatcctgtggcatttaatggcaaagacattgcattaaaattataattttggcataggaaacagatattatggatgctgtagtaatataagtctatacatgatggtgttcgtaacctcagttttaattttctatcataaaaatttgactttttattctgttgcaggacacataaaaccttgactctttcacaacccacaaagctgctattgtatattttagatagttctctcacatttcctacaattataatttttgttcttctttttgtcataagatgtactgagatattgtagaacattttgggtatccttcctccttgttctctttttatgagggatgatttcatttgtattgttatgtagctataaaatttaattgctgggacaccaccttccctccatacataaaagtctgtatctttacacagatgttttgcaatcattaaaggtagaaaccaagaagggatttttttttttcaaataactacctgcttgaaatagagacacttaagcgcacattatggttttaatgtcataaaattggtacttattttagttcctaaatattttatcagtcgtgtaaatgatctgttattagaatgtcagcatcaccaatttaaaaaatacaataaataacctgacacaattcaaaatgttcacaaattagatgactcagtatcgtaaagatgttgactgagctccagattcacaaaatttcaatcaatatcctggaaggctttatgtaaaaatagacaatatagttctaaaatttattcaaagaaccaaaagtagccaaggcaatcttgaataggaagaacaaagtggaaggtttacacaaccagatccaaaatgtttaaataaaatgattgcgtatatacatacaatggaatattattcagtcataaaaaggaatgaagttctgacacatgctacaacatagatgaaccttgaaaatattatgctgagggaagtaaggcagacacaaagtggcaaatatataattccaattatataaaagatctagaatagccaaattcatagaaacagaaagtagtccagaggctactagcggatgggaagagagagaaaggggaactattgcttaatggttacagactgtctggttggagtaataaaaaattttggaggctgggcgcggtggctcacgctgtaatcccaggactttgggagtccaaggtgggcggatcacctgaggtcaggagtttgagaccagcctggccaacatggcaaaaccccatctctactaaaaatacaaaaacttagctgggcatgctggcaggtgcctgtaatcccagctactagggaggctgaggcaggagaaccacttgaacctgggaggcggaagttgcagtgagccgagatcgcgccactgcactccagcctgagcgacacagcgagactctgtctccaaaaaagaaaaaaaaaaattgggggtggggcataaactgtggtgatggttgtaataaatgccactgagctggacacacgaaatgactaaaatgacaattttttatgttatatattttatcacaccttaaaaaagtaacaccgaaatacgattgaattgttcactttaaatgagtttaatggtatgtgaattatagctcggtaggattgttttaaaaaaaagattgtaattaagccagtgaagtactgttgttaaagtacagatttaatcaaatggaagaggatacagaatccagaagcagattcatacatacaagttctcttgatttatgacaaagatgccatgaaaatacagtggggaaatgattgtctttgaatgaatagtgctggatcaattgatgttgctttttactataaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgccatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctgcttgagcttattttcaagtttatcttgctcttctgggcttatgggagcacttacaagcacgggtcctccagtttcatttaattgtttgagaattccctggcgcaggggcaactcttccaccagtaactgaaacagacaaatgcaacaacgtttaaaatgaattacagcacaattccaactaccttgtctttgcttctattgattagtctatcaaaatgaagcgacttgaccgagggcccagtggtacctcaaataccaacagttttctatctgagcacagagctgattgactgaaacactcaccccctcagtagataaatctctgtagaaaataaacgattatattatccctcataaattttttaagagaaaaatgtgagatggtaaagcaacactccaaataaagttagtgtctgaaaacctatctctctatcagaaatagaacaatgtgaacaaattcatcagcctcttgggtatcatagcatgccatagcataccgtagcttgctgctgagaaattgcattatcatcttaagaggtaactgacattgagagtattgactctcaatatacacagtgccaggcactgtgctaaccttttcacatttattatcttagtttatcttcatattataataattatatcaggtagatccaattatcttcattttatatggaaggaaactgagacaaaggggttaaataccagctcccaggacacaaatctagcaagcaacaaaggtgtggttcaaatttgggtagtttcattctggagtcctcattttttacttcatatccctaaatttctcgaactcattcaccaccacatagtgtatgccctttcccaagacctccaaaatcaccatggtgttaacacttcatttttgtcaactaaagttactgtgtctgctacagtacccattagccatacaacgctattaacattcaagttaatcaaaattcactaaaataaaatctcaagttcctcagtcacacgaccaactctccaggtattcaaaaggcacaaatagctagtcgttacaaaaatggatgatgcagaatattttcatcatcacgggagttctatttgaaagcactgatctagattctttcaggagaaaatagactcatgcatattaattaataagaaaatgccactaaatatgtttcgaatgaattatcaattatattactatatatgacactcaatacatttgggaaagataaatttccaagaaaagactgagttcattgttctagggtataaccatcttcaaatgattcccactcttttctatttttgaatcccaaatacctagtaaaacatcggatgtatagtcagtgctccatatttgtttattgaattacgccatattttatttttatactttatttcttgttcaggtgtaaacctcttgtttcacagaaataaacgtttgacattggactctaatttacatgtgtaaagcacctgaatcattgataaaggaccaatttcatttccctttgattatgtgaccgtgtaaaatgaggataatagcaaccattgtcaaaatctgatatgaagattaaataaaatagtggctgtaaatgtatctaatacttggcacataacagggaatgattaaatattaatttctcttcccctttcaccttctgcttgacaactaaaatgaaatagatccaaaagagctgctttcctaaaactaaaaccatgaaagttaatccaattgcacaatcagagcatgtcagtcagccaagggaagtaatcagtaataagcagacatcacagtaggacggtatgaaaagccactggaataagctggatgtctattcaaccaaatggaatgtgaaccaacaccacgtcccacacccccagacaaatcagctaaaacaaaacattgcttcgggggaatataatgcctttaagtagaggctgaagtggtgagactgatctggcaatccagatcttccctaagaaaatggattcttctttttaaagactcttctcaaatctccaggtaggtaaccaggacagattaaaaaagtgattcccatttagatttagattttatgattccacaatctggtcttcagtttttaaaattatatgaagttgtgaagttctcaagtaaaatctaaaattaatttcaaatcaaagataaaaactgtgaattatatacatttagacatattgaatctatacatctatatgtgtagatgtatagatgcaatatgtgtgtgtgtatatataaatacacacacacacatatatacatatgttcttatgtgcactggttcagaactgcagggttaagaagaaataaagttgtgagaaaaacactttagcaaggaactatgaataacctaatgggcagaaaaccaatgattgaattaaaaaatagattcatatacttctttatgcaagcaggccctgggggatttgagaaaataaaattaccttgacttgctcaagcttttcttttagttgctgctcttttccaggttcaagtgggatactagcaatgttatctgcttcctccaaccataaaacaaattcatttaaatctctttgaaattctgacaagatattcttttgttcttctagcctggagaaagaagaataaaattgttatttttttttccaacatagttctcaaactatttgttaatgcaaactgggacacaaacatggcaatttaaaaataagcaatttaaaagatgttaaccatacataatttaagaaaattcattcactttgaacaaagtaatttcaatatttcaagaatctctaaatgataagagattaaaatcgaacaagaaaaattctgattcaaaaattcctggccaggcgcagtggctcatgcctgtaaccctagcgcttagggaggccgatgtgggcggatcacttgaggtcaggagtttgcgaccagcctggcaaatatggtgaaaccccgtctacactaaaaatacaaaaatttgccaggtttggtggcaggcgcctgtaatcccagctactagggaggctgaggcaggagaatcacttgaacgtggaaggcagaggctgcagtaagccgagatcgtgccactgcactccaccccgggcaacagagaaagactccatctcaaatacatacatacatacgtacgtacatacatacatacatacatacattaaaatgaataaaataaaaattctaacaacattatgtcattatatctgagcaaggtttctcaactttagcattactaacatttaggtttggaaaattctttgctgtgagcagctatcctctgcattgtagggtatttagcagtatccctggcctgttgaacacactggataccagtagtaacacctcgcccctgagctgtgacaaccaaatatgtttcaaggcactgccaaatatgctggggggttgggggtggggacaaaattgtccctggttgagaaccaactaaagtaagtatataacctaaagttacaagttttaaaatgtttaattaaagtatacttatggaaaatgagaggacaaaaatataaacaaggtttttgttttgtttaagtagcagccattttatctgcttcttattctgtgggtcaaggatttggatagggctcagttgagcagttctgctttatgtggcttcagcttggtttaaaataaaacactaaattattacatgctaaactgttttccgaattatgactcacaaccttatttgaggaaagagaaaaactgatttaaaatacttaacatatgttgtactcgtggaagttttaattatgaaaatgcatataactctatgctaattagccataaatttattcttacatattcgattgtaagacagctgaacaaaattgtttgtgcttaaaataattgaaaattttttgttttgttgtcttttgggaactatgtgtagcttccatggaagcttttaactgaagtgtaatatacgtacaggacactgcacaatttaactgtatagcccaatagtgttttaaaaattgaacacactgtacaaccagagaaggaaatagaatattatcagaatctcagaaatctcctcttatccctttgcagtcactgcctccaagtataaccagtaccctgtcaactttgattattttgccggtactgaatattatgaaaatggaattgtatggctttatactcctttgtgtctcgcctttttcattcaaaattatgtttacgataatccatgttgcatataattttagtctgttcattaacctggctgtatagcatttaattgtgtaaatatagtactttagatggacatttgtgataattcagttttttgaatgattagctatttttttttttttgcttcaaattaacaaatgtgtattgggagcttactaccttctaagagctcaattgggcattaggattaaagatatatacgttatataccttgtcttgaggatttcatagtcaatgagaagaaacaagcatgtaagccaaggattatgattaagtattataggaggagaagttatttctggggcagtgcttgggagacatcccagagaagataatgatctgagtcttgaagcatgaagatagatcagcatgttgcaggaataagacacagcctgttcaaagacagggccttgagagaactacagttgcgatcattctgtaaatcagaatctggttattggacttatgcttgcatatattcattcagttttcctatatgataagagcctgttcaaagtctgttctgggacacgtaaagttacattctcccctctgtctattctcttttaaattcatttatacatttattcgcttatttttacaaatgtttatgatttattgtttttaatttttgtagggacatagtaagtgtatgtacttgtagggtacgtgagatattttgatacacgcatgcaatgagaaataagcacatccactgttcattcctgggacactgggagcagggtctgtttttaacctatcccgaatataacatctgatctagaagtacttctgccttatctgactgggaagatgaatgctatttacttcagctgagagtatattttgttgtctcatatattttggggaaactactagtttaataaatcaagagatctggagctcggggagagaggaaagctggaaataaggactttagtcattagcaatcagttggcagagaaaacacggtaaactaacttttgaactaataattaacatttcatgtttgctattttctgagtccattctttcttcgttttatgaattttaatcattgacaattctctcttatttaaattgaaaaataggaaaagtcaatttcaaagccttttgttgatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctttttaatcttgcctgggacacggagtacagaggagattggaaattgcttggaatagagataataatccctgttgctttagagtaaaccctatggggaagtggctggtctcgattgctggcagtttgttttagaatgtggaacagcaccatttcccctcagattctgaccttagaatcaattgtggaagaagaaaacgtctagtatagtacaggcatcctttatttgtttaaatgttccaagcagatttaattccttgggtctagattttgagggtctatctcatctttttctctctctctgtttctactctgcaaatcattgcctccattactatttgactccagatgattttgcacagtgttctgaatacttttagttaagtaaaatcttgctaaaatctgattacatttgaaaaacctagacacattggcaaggcttttaaacattttcaactttcatctagaagcagacacgtttaaggaaaagaaaaccccaaaccccccaaacaaacaaaaatttaaggagcaggaaaaagtaatatcaaaccaaaaaaataataataaccctcaagtttagaaaattctaaatcaaacactcccctcttttcaaatatgtctcaaattatttactagcatatttttttctatcaagaatatccagtacagaggagagatgttgtgcttattcatcatagttgagatttatatgtattactgggttcaaaccctatattgtatgcttattttcttcatttattattctactatgtgtctctgtaggtcattaattacgctttaaaaacttgattttttaagatcctagtaataagatatataggggtaccctatatttcaccattattgtgttattaggaattttgtttgctttcattttttattataatgaataaccctacaataaacacatttatttatacattttgaatcatgtatctgctggaatgagaatgaaaagttaacaatgggaatcctaaggatttagatacacattgttgaatttctgtcaaggttggtactcagaacactcgtaaactcccaccaacagttacaaaatacttgtctcactacacttttgccactattgagcattataattgatataccaataaaacaaataaaaagcttgccatagatattttaagtattctactaataggaaagttgaaaatgttgtatgtgtgtacatgtttgtcatttatttagtttccactgtcaattatcggcaatgtctgttgcccatttttcctgtgttttcctatttttaagagctcttttcacattatctgaaacatagattaattgagactacgtttccagcttcctttttgccttttagtagttttttctaaataaaatttaacagtttatttctttgatattatgttcattgatagtatccttaaaattgtggccattttaccattgttcagatattctcatttattcttgatcctttactctttcatttgttaaaaaagaacaaccaaatatttaatccatcttaaatttatatagtgttgtttctaaccttgaagagtttttcagaaactgatattttttcccccagcaccatctcttctgaattgatttatggtgctttcttcatgatattttaagtttctgcttgttgatctactgtagatttttgtgacagtaatgcactatgtcaattattgcagctttaaaatatgtttaatttctggtaggttaacccgctctcccactttagttattctaacttatgtaatgtatcattcagtcaaattataaaacaattctcgctgaaaatttttaaatgggattgcattatatcaataagttaatttgtgaagaattactgcctttccaatataattctgctaaactttctgtatttacagtgttcttggacacagagtatctgggactcaatgggacactataaataattaagtacattttataattaaccttcagcatcaatttgaaagacagcatcttgcatatgattttatggatattaaccatatactaatttagaaaactcttaagaactctcagaataaatcatcacttaaacagtaaaagctttggctaagctttttgctgtctttctttttacacgatatttgtggaaaactttttttccagtgatttaattttttaaaaaaacagcatcttttaaatatgaaaacatttggtagtcatttcttatctagattttttttatactttgaaatataaaaaagatggtgacaaaatcccgttgggaccttgttataatctgcttttccaagcgcatgtgttttctgaaatttcaaaagcctcgatttgaagttttaaaagctgcaatttgaatttatgtattcagatgattgcagaaaagcaaagaaacacagttagcatttccaggcttgtctcttgacagaacagtttaaacgtgcttcatattggcattcatcacatgaagtgttatttctttgtttacctacttgcttaatgcttatgggaggatttattcagacaagtggtagtaataataatgagtgagatatttaacattacccatctgcaaataagtgctaaatattttacttttagaagcatttcaatacatttagacatttagctttttttagaaagaatggcttctgtttgaaatattggctctgttaccatttacattacaaatgttcccaatgaaattaaaggaagcacgtattacgatggtgagagatttgcataatcagaaaggaagcgctactcatgtgttgctaaattcaatgaatttaacattaactcttaatgaacattttctgtcgggctactcttacgctaagaggaatagactgccaaatcacatggcatgattttggtgaggggatctaacaagtgtttcaggtaaagtgctagatagtttcacagtggaatcttttaatattccatacatcctttggattgccttttatatgctttcaatgaagaaactgaagttctagagattgatacatcacatacccaaaggtgactatcccattttccaaatgagaagtccctctctccaagttttttgatcacctttaacatagaaactttagaaaatggagatacaatgatcacctgtttacatataatgtttaattcattaatttgattgtgtgtactactttaaaattatatagtacaaaatattatgtcattagatcacacttcttcattcatatttcatgcaacaattttgttcaaattcttcacaggcaccttcaacattgaaatttgcatcctcatggatgcacttgttgttgcctaactcagttttccagagggcatcatctttacttacatccatgtggcctgaggtatagtactgctgaatctagaggtaatgtttcactaggaattttactgcaagccacaagcacacatttacataacagaatacagttttatgttatgtaaagacagctttatcttttttctgtgccatatgtccatgagctacaccatgtaaccacttaatgagttacttttaacagtattctttccatagcttgtttacaatggcatccaactcttgcaattgtgatgtcatacaaccaaagtcaatccctaaactgtgttaaatttattttctcccagtgtgtgtgtgtctgtgtgtgtgtgtttttgccctcctctatcaggtttacttctacaagcctccaaaataagcataaattgagaataagtcaaggcaatacatctttcccggacagtactttgttgttttgattgaagtaaaataaatgaccatcttgtaatttgagaaacttcagaaggattcaagtataagttgacccttcccgagggaaaaccaaaacaaaacattgatttctacacacacctagtaacctcctcaggccataccctccgtaggtcattatcagaatcagaacccaagcatcaactttatttttaagccaacatgtctaccatacctggttggtgcttgagttgtacaagtagacatttgttcattttccctaaagtttgtgtcttgtcggaatgaagtgctcctgagggggataatatatcaagatttctcagtcatttatgcctcactattaaggaaatgattagcaacttttgagtagatgtggaaaacgatgagggaaaaacctgaaggttagcaatgcgaatatctgtatggaaagtaagtccaaatctaaatgctgccagttatcagctgagtacgtgaacacgggcgagttccttaatctctttagccctcagtttcctcgtcttaaaattagaacaataaacattttagagtgttgtgaggattaaagttttttttgcagaaacccaagatttagcctagtgcttcactaacagcactcaaaaaaaatggtagagaacataaaaggaggtacaaaaaagggaaaatatggatacagagctttctgttttaatcctagaattgtgtctaagcccacgtgcttacatagataaaagtatttataaaacattatgagtacacaggaggagtactcaaaattgaacttttgatgagccacctgacaactttatttctccctactgacaaactaccttgacaaattttgctggggaaaaaacaatagagaattaatgtcaatctatgagtaaatgtgccaccagatgagactacttctaggtgaagcatatatgtaatcacaatgcaacagccatttattgagggtctactagtgtccattgatatggccgtgaatatcggcagcaatccctgcctcatggaccttacatccgattgggaggaaggggaggcagacagtaaacaagataaagaaataaaatctatagattgtgatacagtaagtgttacagaggaaaaaaatgaagcatggaaaagggatggaaatattgaggggaagatggggagcagttgtgattttataaagggtgatcatagaaggttccatggagaaggagacatttgagcaaagtcctcgtggtagggactggctagctgctcattagacaagtctactcatttctcttaattgtgcagctagctgtcatttcccagtctcccttgccattagtttggctacatgactgagttcgagccaatggagtgtgagcaaaagtgatgctcatgaatatgaagcctggctcataaccccacctccaataaccaccaccacatatgtaatattccttgttctttttcattcttatgtacaagagcacagtgattttgaaatccgtatgttaaagacatcagagccacaaaagcgaagtgccctgggcccccctgatccaccatttggaggaaatctacttgttgaccagaaaatttttgtaaagtttgcatgaacggaaagtttctattatgttaagccactgaggtgtgggcttttttttttttatagcagctttaataaagataggtaatatagaaataaagaagcgagggaggaggccatgcaaatattgcgggaaagaacgccctaagcagagaaaacaagtacaaaggccttgaggcaggagtgtagtaagaacgtcctaaaaacagcgaagaagtgaacaagaagttcagaaatggagtgaggaaaggagattactagatgtggcccaaaagccttctattcagagattctatctggaatctgaaggcttttataatccctatcccacatcgaattcagtttctgggtaaaaataaattatagagcaatatgtttgggaaatctcagactgaactgtgttctccaatgctactttaatagatccaatcaactaactgagccctaggacttccccccagatttttgtgtgtgctgtctacacagttgctgaaacaggcttcgggaaaatctgaggatgctttggatcttcatctgtcagaggcagagttacatcacctatcagtaaagcctgtcacaaagccattaccatccgatagaaaatgcaattaagagggtatgacttcaaaccgttttttctgatttgaatcccagttcagtttttcccttcgcagacattcaaacaccatcatcttcctgcctaaacgtgctcctctgtcaagttcaatggatgactccaccagctcccggttttttaagctgaaagtgtagaagtcatccttgattcttctctctccctcactcccagagcgtatcaataagcatgtcctcataagtccacttgagaaatctctcttgaatctgcccacttctctccatcctcctgtcgctgtctccttcgctccttctcattctgatttcaacttttatttttgatccaggtagtatacgtacaggtttgttacctgagtatgttgtgtgatgccaaggtttagggtaaaaatgatcccaccacacacaggtagtgagcatagtacccgataggtagtttttcaacccttgcccctctccttcctcccccttctagtagtccccaatgtctattgttttcacctttataatgagtacccaatgtttagcttctaactatcttcggttttctgttcctgcattaattcacttaggataatgacctccagctgcatccatgttcctacaaaaggcgtgactgtatgctttttatgactgtgtagtattccatggtgcatgtataccacgtttatttcattcaatccaccactggtgggcacctaggttgattccatgtctttgttactgtatagtgctgcgacgaacatgtgagtacatgtgtctctttggtagaaagattcgtgttcttttaaatatataccaagtaatgagattgctgggttgaatggcagctctcttttaagttctttgagaaattttcaaactgctctccacagtgcctaaactcatttacattcccataaacagtgtataagcattcccttttctctgaagcctcaccatcatctgttgttttttgactttttaataatagccattctgttctgatttctaacagcctctctgagactgctttctaattagctcgtgcctcctaccttgtctccttcttatccactctttacacttcagaataagagatctttctaaaatatgttgctgatcatgtcctcatatactcaacaacatcctagtgccaatgggataaaatataacttctctaacatggtcaaaaagccctttgtgatctggtctctacttctatttcttcatctttctttgcactgtatagttcatggaacaacttactcttccttaaaatccagcactatatccatatcaggattcatcatacaatgttccctctgcctgggatgtccttccatacatcttcatctaggtagctccaggttgacctttccaatctcaggttagacatcacttcctctacaaagctttccttgattaattagacatccccaacccaggtataggtcacaggtcctgttatgtagtcccacagcccctcataatgtttccatcacaggaaatactgtaatttcccatgttcatcaaactattgcagattttctatctattgtgatcgcaccctatcctcagtacttagcatatagtatttgcttagttcctatattaataatctcctaatgacatcatcttaattgtatatctccaagtaataacattatttcatagtagtctggggagattttccatgaagaacaaagtgtgtgtgtatgggaggcaggttctgtataaaattaacgaaattcaaccagggaaagctatacagcaagtgtttgtaaactatggctcatgaaccaagttgtgctcaccacctgtttttgtaaataaagttttactggaacagagctacactcattcatttacatattgtctatggttactttcatgctacaatagcagagttgagtagttgcagcaaagattgaatggcccacaaagccaaaggcatttagtatctggcactttactcaagtttaccaccatctgctatgtgataaatctccttcttagacatctactagggaattaaagatacgagagttctgatataagaaaatctgtataatctctataaaccagtggtatgcgaagtcatgaaaatatctatgataattagaactactcctcaccccttgaaacaatcatgagcactttacacaattattatttcacaggacaaatagaaaaactagacattgcatctgattataaacattaattctgtttaaattcacgaacatttccaactatgagaaactatatctacttaccttagaatcaaacatggaaaatagtcaaaagacctatgcctctgcctcacttttcttgtcttggcttttacattatgccagtttctttatatttctctttcttcctaacccacaaccaactttatcatttattttataatttcacctcttttttgttactcagttttataatttcacctcctattttgttactcaatttttttcccctctgggctttatggtgatttttattactgtgtctgtattttgaattcctcgtggtagtaattctttccacccccagaaaaaatgtcatctgttttctcaaactatgtatgtttccagtggaatatgaatacattatatagagacggaaacccgaagttccccagagagtgagagagagagagagagagagagagagagagagagagagagagagagagaaaagggaacattttgatcatcactttcatactcgagcagaaaggcaaagggtatttccgtttcacttatttaaactctgcacataattgcagctaagttcctcagaaacagaggttactattctttaaaagaatatagccacaggaggtacaaaaatagttatattccctgaaacagtatttccttaaatgtggtctggggacccctgggagtccctgagacccatgcagtggttctgtgaggtccaaattattttcgtaataatactaagatgttatttgactttttcctctctcattctattatgagtttttcagaggctacatgatgcgagatatgacagcacattcaatgcagaaacagatataagaaccagctgccttctcttaagctaacttttaaagagatttgcaaaaatgtaaaacaagatcactcttctcactatattgtttctgttgtagaagagatagtttaaaaactaaacatttattttttatttcaacatgcaattttaaaatgaattaataagtaaatattttgaacaattaccacttttttttttttttttgagacggagtctcactctgtcgcccggctggagtgcagtggtgcgatctcggctcactgcaacctctgcctcccgggttcgagcaattcttctgcttcagcctcccgagtagctgggactacaggcgcccgccaccactcctgtttgtttgttttgttttgttctgcttttttttttttttttttgtatttttaacagagacagggtttcaccatgttcaccaggatggtctcgatctcttgacctcgtgatccgcccgcctcggcctcccagagtgctgggattacaggcgtgaggcaccgcgcctggccaagataattttttttgtagaaaaataatatgtccttgtcaactggcataagtaatgacagcttatcatgcatgccgagtttgtcattataaagacctcagacaagtaaataatacaatgtaaaatgaaaattgaaataatccattaggtatgaagaaatccaccacaaacattccagttggagttcagaaatttgccaatgaatttattagagacagagggaggtgaataatgtaggccaatgactatgagggtcaacttttagagttaatgaactgcctaaatatttactgggaatctctgtgatatgctaggctaagtagggcaccttcaaatgatatacacactgctcacttacagattatatttcactgaggcaagctcgcctgtcattaacttactgtattttatcaacaaatatttgagcatctaccacataccaggtactgattttgctacttgatgaggtagttaacaaaatgttgacaggctagtcagtgatacagatacatgaatgggtctccttttttttattgtttttattttttgagatggagtctcgctctgtcacccaggctggggtgcagtggcgcgatcttggctcacagcaacctccacctcctgggttcaaacgattctcctgcctcagcctccgagtagctgggattaaaatgcgataagcattgaagtgtagctatgcattcaccaaacatttattacacatctaccaagggccaggcactatactatttttgctggatattcaggagtgaacaaaacagagccagtccatacacgtagcttatggtgtcatgggtgacatcaacattaaaccactaatcatacaaaagagtttaatgcaaaccatacatatatatagaaaaaaattaagattgttaggagagtactccttttttacaaactttcactttcagaactttcataggtatgttgctcctaaaggcaaatatgcatcaaattttactttccatgaataaatggggtcactggtcagctatagttattatagtttttggtatcatgtctaactttagactaagatgtgtctcctctgtgtgtatttttgaaatgttttctaaacattattaatctcattatgtgccatgagtacaaaagcaaagcaaatttgttgagagtcctgggaaaacatagaaaagaagcaataataacaataataatcaaggtcctcaacatttataattttctcaaagggcttaactgaatatctatcggtcttttgaatggagacatatgttctaagaacaaaagcacttacagtcatttggaatataacctgtttctaagaagagcagtggatcttacttagattgaaaaggctgtggtggttgtaacagtgagtccctctgagtaagtaacattgaaattgagccctgaaaactatgtcaatatcagccggaatacagatggtacaagacaaaggaattagcttttatcaaggtagaagaaatacttagcgagtcagaggaattgaaactaggaattcagtgtggctaaagtttagagagaaaaatggagagttgcaggagctaagtccagagaaatggacaggtaatatcttctacattacctctgggcattaaaatttgattctgcatgaactttattagtgtattatttattttacatccatgtcaattactaaattcattaaaaatttggtacaaggtacagatgaacttagggagtctacctaacagattactcaagattggttttgatccttgaagtagaccacttcacttagctaagcatccgttttaaaatactagaatccaaagggtatcttcaaggatttcttttttaaacagacctagccatgtacaatagagtcaaggcagtgtaaactaaaatatgtgttttctggttctcagatcaataggacatacagcagactgacatagcacttaggagaaaatttctctgtatgtttacgaaaactgaagggagtttttttttttttctccactgggagctgaccatcattaccttccagctgaatctatgagagaattctgttcccattctcctgaattaatagttgctaagaaaatgccacataatttatttgctatatgacttaaaaggcaaagcataatgaaaatgagagtaaaataaaaggccattaacgagaaaatattgcatatataaatttgtgtcatatatatagtaaatttgcatcataccaatatcagggagaaaagtaagattaccttgtcaagcatcaagcacaagtagctaaaccttaaatacagtggataatgaggaacactgagataccaatattttttaaagcttctatttatttattttgagacagggtctcctggggtgtggtagcatgattatagctcactgtaacctccaactcctgggctcaagaaattctcccaactcagcctcccgagcatctaggactacaggcttgcatcaccacagtcggctacatttttaattttatgtagagatggaatgttgctatgtgcccaagctggtcttgaactcctggcctcaagcaatcctcttgccttggcctcccaaagcactgagatgacaggcatgagccatgtgcccagtcaacttttaattttcatttaacagctttattaagtatttaaggtgtacacgatgggtccataattaacaaacagatcttccccgactgactacgatggtttgacttacaattttgaagttcaccatggtgcaaaagcgatacacatttagtataatcctggactgaggatggggttatatctggatatactcactgtaagttgaaaatatcattaattgaaaatgtacttttgactcataacattttcaatttatgatgggtttatcaggacacaatcccatcctaaggtgaggagcatctgtatacaatgtgatgaattgggatataagcatacaaccatgaaaccatccccataatcaaggtaaccaagtatatgcatcaactccaaaagtttgctcatgcccccttcattttttctttcttcttcttcactttctccttctccttcttcttcttcttcttatggtaggaacacttaagacatatcctcttaataataatttaagtgcacagtacaggcactatgttgtacagcagatctttagaacttatttacattatataactgaaactttatactcattgaacagcaactcccagttcccccttcgcccagcccctggttactatcattctactctctggttctacgagtttgactgtctcagacacctcatataaatggaatcattcagtatttgccctttggtgactggcttatttcacttagcataatgccttccaggttcatacatattgtcaaatatggcaggacgtccttcccttttaaggccaaataatattccctgtatgaatacaccacattttctttatccatgcattcttccatgcacagctatgctgtattgatatcttggctactgtgaataatgcttcagagaagatgagagtgcagatatctttttgagattctggttttaattctttgggatatatacccaggagtgaggttgctggatcatatggtagttctatttttaactttttcaagaacctttctactgtgttctatagcagctgcatcatttttccattaccacctatggtgtactagcgttccgatttcctcacatcctcaacaacatttcttatctcttgtttttggtttgtttttatagtagccatcctaacaggggtgagatgatagtgttcatctcacagaggttttgatttgcatttccctgatgactagtgatgctgagcaccttttcacatacctgttggccatttctatgtcttctttggagaaatatatatttaaatattttaaaaatcaagttatttgcctttttcctgttgagttgtattaacaatcagctctgtttctgtacactaacaataagctacccaataataagcttttcttctattggattatcttgtcacctttgtcatatattgattgaccataaatataagagtttattgctggactatcgagtctcttccattgtcaacattaggagtgcagttagtagatttaagaaaaaaatatgaataggtttgtttcctaaacctacaggtgatctataagcctgtccttatgacagtaccacactgtcttcatcattgcagatttacatcaagatttgaaatcaggtaatgtcctgatttcaaagtcctctaacttttttcttctttttcacaattgttttggctatttggtacatttgaattgctatatataaattgtgggatcaatttttcaatttgtgccaagattgtgcaatttttcaatttgtgccaacatctgctaagatgtcgatggagattgcattaaatctatagaacaagttggggagaatcactaccttatcagtattgagtcttccaattcatgaacatggaatatggtcccatttatttagatttttaatttctctcagcaatgtattacagttttcagagtacaggtttagtacttatattttcaaatttatgaccatttaatctattttatgctacaaagaatgaaattattttcttagtatcattttcaattttttattgctagtacacaggaatgtaatttattcttgtatattgattatcttgcaagcttcatgaacttatcagatctagcagttattttgtggatatcagatttttctacatacaggattgtattgtctgtgaataaagagagtttcatttcttcttctatactgtggatgcctcggattcctatctttctcctggacctgggtttttttgttggaaaattttaaattactaattcagtttctgtgtttgtgttaggtctattcatatgtctatttttttcttgaatcagttttgttaatttatgtctttctaagaattttttcatttaatatgttttgcagaaattgttgacaatgttgttcatgttattacattctagtctttctaatttctgtagggttggtagtaattacccctttttcctttatgattttggtaattcttttttttttggtcagtctagctaaagcttctccatgtaaaaaatattttcaaagattaatgtatggtttcattgatttttctttcttcttcttctattttattgacttctgctctaacccccgttatttccttccttatgcttccttcgagcttactgtgttcttctttttctagtttcttatggcgaaagcttgagttaatgatttaagaattttattcttttctaaaataggtatttaaaactagaagtttccctgtaagcactgctttagttacatcctataaatcttgacatgttgtgcttttatttttattcagttcaaaatattttataatttcctatgtgatttagtttttaaccaatggatttagaagttgttgaatttcaaaatattttgatatcttccaaatttccttctgttgaattccaatttaattctgacatattaagagaacataatttttatgaattcaagcctgttgagtgtattgagatttgttttttgacctagcatagaatctatcccagagaaaatttcatgtgcactttaaaataatatgtattctgctttcatttggtggcgtctcctataaatgttagttaggtcaagctggttgatagtgttggtgaattcttctatattgttgctatttttctgtctaattggcctgccagctattgagagtagggtttgaagtctccaataataattgttgaattgtctagttctcctttgaattctgtcaatttctgcatcatagaatttgggactttcctattaattatatacgtttataattgttatattttctgcttaattgaccccttatataattaaaaatgtctttttctcttgttacatattttgtcataaagtctattttgtctgacattagtattgtcacttcattttttatatgtaaacaatttgcatagtacctcttttttctttgaaattatatggttttggctctaatacatttctcttttaaacaaactatggttggatattttaaataatcctgtctgaaatctctgcctataattggaatgcttagttcactcccatttactataactattgatatgtaggttgagtatcccatatccaaaatgcttgggattggaagtgttttggattttggatttctttagattttgtaatatttgcatatacctaatatcttggagataggacctaagtttaaacacacatactatatatatacatatatatatatatatatgtgtatatatatatatatgtatatatatatatatgtatatatatatatcttaatagatatcttatacatataacctggaggtaattttataaagtatcttaaataattttttgcatgaaacaaagttttggctgtgttttgactgtgactcattacaggtcaggtgtgaaattttccacttgtggtattatatcaaccttcagaaagtttcacattttagagcatttcaaatttcagatttttttaatgggaattctcaacttttagttgcaattacatgtgccatattgtattttttcacatcttattcatgtcttttttgttcctgtttctcctttactgcactgtcttgttagttatttttagtgtgtaattttaaattttgtttttaactatttattttcttagtgcttgctctaaagattacatatgcatcttaattgatcataatttacttaagttcaaactaatttaacacagtaaaatttagatatttttctctgctaagctccatttttgctcctcctgcttataaacacaataacacaatgttataatttttatgcaatcttaggtcttttaaagaagttaaaagaagaaaaacatatatctatatttgtacagtcttttatatgtatctacatatttatcagttctgtgattctttatctcttcatttgggttcgagttactgaatatcacttcttttcagcctgaatgactttatttagttttttcttgtaagtcaggtcagctagcaagaaatattctcattctcaacttggtaatatatttattttacctatatttttgaaggatagttttgttttatgcggaattcttggttggcaattttgtgttctctgagaactctgaatatgtcatttcaatacctctggcctctattgtttatgatgagaaattaactatcaatcatgtgatccctgtacatgaggagtcatttttttctggttgttttaaagactttcccatttgtctttcaataatttcaaatgaaactatttcaatagtttgactcttatgttttagggtattgatctcttcgtgtttattctatttggggtttgttgagcttaaccgtatttgtgaagtgtttggccattatttcttcaaataatttttctgcctctttaacaacattctctttttttctggaactcttgtaacatctacattgatatgctcaatgttttgacacaaagctatgactcatgttcgttttttatactgttttacctctgacattcagattggataatttttatttatctattttcaaatttactgatttttttttttttctgtcttactatctgctcttgagccccattagtgatttttttaaattttggttattctactttccaattctagaattttcatttggttcttttatatagtgtgtatcttttagttgagattctctatttgtagttattgttaccatactttcatttaattatttaaacatgcttttcttcagttgtttgaaggtatttatagtaggagcctttaagtctctatctgccaatacctgggccaattcagagacaacttttgttgactgcttttccccatgagaatgggtcacagttgaacgtatcgtaaatttttcttgaaaatttgacattttaaataacatattaaaggagccccaaattctgatgttccttcttatgcccagcgttttttaaattgaagttttaataacttgcctagatgaaatctgtggaatctgtttccccacagtgtgtggctgttgatattctttctctgtcaaacaacagaaacaaactgtatgcctagtttcctagaggtaagcatagcttaatttgcattagtcaatagttggccagcagttgatcttaaatacctcaagccagtaagacttccaagttttgctaaaggttctttatatgtgttaaagggtatattcaacatgcaggcacattttaagttttcatgaaggagacacaaggagtccttactgaggcctattacggctgcctcattttgcagatatgctggttaaattaaatttctggccagtctgccagtcagttacttgttccaatcaagactgcaactttaggccagctgagttgctattctgcctttttgtttgccgcctaggtctccaccgttactgacaatgcttctggacatggagttttaaacttctgcttcaaataaaatcagtccctgtggtgatgaagctgcttatttccatggcttgttctaccttgatagaactattatgcttgaccaagctgggagtggggactgggggcaatacaggcaaatacaccacaaattcatattgttcatatacaaagtttagtactttttataaataatcactttttaatttagcatatgccgttggttgatatccagggtcataagatgttttctccagtgtgtcccattttactgattcttggggagatttatcgagctactcactttatcatccccagaagtcatgtacccagacactaacttctaagcacctactcatgtgctgggcatagagctagccaatttatttacattacctcttactcttacaacatctctataaatatgtactattatctttatttttggattagtaaaaggaagctcagataatttaagtagctggtgcaagagaaaaaagaacaaattaaaaatataaacgcaaagataccatgttacatacttccaaaggtaataaacacaggtgggaagataggtgattattacccagcatttagttgccaggtttatgtaatggccaacctgaagtccaagtactctgatttactactgcctagtataaaggctaattagcaagaaaacaccaaataagtcagtaggagaaacaagctgtttttgtcatggatagactctaatcattaaaaaaacaatcattatattggctcataaagttagaatttgattcgcacatgtaattctaataaaatccagggtcccacgtgacccatattcgttaaagagttacaccaacagagaatcagcccagcaaaaatagatcatcaaaaaataattataatctcaatttacattttaaaattaatatagggaactcatctacaatttacagaacattccagaactttcatttcttctcctcctcacttttttttatacccatccagttcttcacaatctttcaacctctgaaacactccagaaaccgtatccacattcacagattctcttgttatctttatggggtagataaaccttgcttttgtagatactttccttttacacaatcgtcatttttccttaagtattctccaaattccacaccatttaaaatttataggatgaatggataaagaaaatgtgatatatatatatgcaccatgggatattattcagccatacaaagggtgaaatcctgtcatttgcagcaacgtggatagaactggaggtaattattttaagtaaggtaaaccaggcacagaaagacaaatattatgtgttgtcactcacatgtgggagctaaaaacatggatctcatgaaagtagacactaccttggtggttaccagagatcagaaataggagtagggagaggggacaaaggggaaaaataacataaatttacttattaccactgaactgtatacttaaaaatggtaaaggtatatttacttttatttatatagaggtatattttacctcaataaaattaaatttaaaaaattcaggccaatcacattggctcatgcctgtaatccccgcactttgggaggctgaggtgggtggatcacttgacctcaggagtttgagaccaggtgggcaacacagtgaaatcctgcctctaccaaaaaaaaaaaaaaaaaaaagaaatagctgggtgtagtagcccgtgtctgtggtcccagctactcaggaggctgaggttggaggatcgcttgaacctgggagatcaaggctgcagtgaactgtgatcatgccactgcattccagcctgagtgacagagccagaaccccatctcaaaaaagaaagttcataaaagcatatcaaatatagtacttttccttagacataagaggaagcacatatctgagaagacacaggcttgaagctgttaaactggcaaataatcataaatgtagtggggaatattcactttcttatttgttctaccctgtcgtcactattagctgctttgttcacatagctagatatggtcatatgtaacaataagggaaaaggcacagatctgggtctaaatcactgacttttagttctcgatccttctataactttggttagccttggacatatatcttgttttttcttgtgcttaatgtggtaatttgtaaaatggacataagaatgctgccatgctttgcttatgatctcgaagagtcaggtgagatgatggacgtataaaatctctataactgagatattgcgacaattaagtgggaaacatttgtaaaactcttatcaaagtcctgttcatagagtaaatgcacaaaacttagtgtcattaatactagctcttgtaacttccaaatttatagtttgggtacatgaatagatagtgatatcacccacagtagattttgggagaggaatataacatgttgagttttggatatactgactttgagatggctttgagacatagaagaggaaatggtccatttgaagctacatatgtaggtctaatctgaaactatatattgggccaaatattagacttaggccataaaatgaaatcggtgactttggtagagactgcttagctgcttagcccatgatccattccactacattttgaatgcccattgcagtttggcattgtcatgagaataaattctggccaatgacatacaagctaaagtgttgtgtagatcttccatgaagtccctttaaaagggtagaggtatcccttttttgtccacttcctacaccttgcagcctttgaaaagcagttgtgatagatagagagctgatagtcatcttgatccatgagtgtaaggacctcaccaaaggatggcagatctgtgagacagaagggatctggatcttcaacatcatagagcaatgataccaacctcggactacctactggcagattccttctacaagaagatgaatatatttctactttgtttcagttactataattcttttttaatctccctagatattattctaattgatacagtgaaagctacatttgttgctatggataacaatcagggaaaccgtatagaatgagaagaagggagggttcagaacatgtcctagagaaacatcaggatgtaaggggcaggtaaagcaaggagtgtcatcaatatagtaaggaattacatagagaggtaagaataaattcagataagattagtgacttggaagataagataggaccaagtgctaatacggaaagtgttcagttaatggcacatggcctacggataataggactaagatatgtccagtggatttaactacaagaaatcattgttgttattggcaataatggtttctgagcagtggtttggatcaaaagcaaacagcaaaagagaggagagggaaatgtgataatagagaatgtgtgtttaagtaacagtgactaactatgaagaagattcaaatgggaataataacaagaaaggggaagtaagagacatttgttaactttggttgcccagaatctgaatgccctgattatgtcgaacaaaatccccaaatacaaatggaatctgatgggggaagttcagtttttgaatctggaatgagtgacagaattataaggcactatctagaattctttccagtagcaatgacattcttcacccagtgtctgcagtggtagagtggtgcatggcaacgtttacatctagtgtatgggggccagacgtcgtggcacatgcctgtaatcccagcactgtgggaggctaagatgagtggatcgcttgagtccaagagttcgagatccaatctagggtatgatttggactatagttcttggagctgagcctcttttttgagttctgcccattttgagctggttttctatccctttgtttaggaatgggaacaggtctgtatctttctcctaaagtccgtttccgcttctatcaacaaaaactgggttctgttattcacagctatgaactctgacaagtacagtggaatgaatgcatttggaaaggaatgtctgaatatatttatattgtaatctaggagctaaaaacattcacctgatcagggatagtgaggcagcagaaaaagggtaaagatatgcttgtgtttgtgtgcattcaagagacagaataattaaccggggcaagattcctctgaaatgagagataaggctttctgctgaatataaggattgttatacattcaccatcataatggtaaatgataaattgttagattggcagcttacacaaatatagtactttcattttacaaacgatttttaaaaacatttatcatagtagagagagataaaataaaatattttaattcaaattaacctttgtagaaaaaatcacattataataaatttagacttatattaatggtcaaactatgacaacatataattagtaaaacaaaagagaattttaaagggaacatgataatagacttattatacatatctaagacatccattaactatattaaaccaaggtaaggaatcaataaaatgatcaacacatttttctcttaggactttgggttttcttttgtaaacaaaggtaggacactcacctgaggatagtgtattccttttttggagtgttatgatttgtgattctaacataaaaagaactttgtaaataagtgtttctaattataaaatgtgtctcaaaggacaggctttgagggtagacaattcaagtttcttcagcaacaaggaaaataaatgcagaatgccatttggcctgttttttttttttttttttttttttaaaaatggtacagtcttggtgcagctgctgttgggtccaatcaacagatagactttaaatgcaataaccttaaagggagagagaatttacagcaacccaagtaaggagtctgactggggcatgtatttctttgtgtttccttttcatgttatgggctctgtagctacccttgtattgaccatttgcagtatattcaaataaatgctgtattcatactttaaatatacatatgggcatctactctttccctagggtgccccaaataaaaagggctcatttcttatctgcaatctgtaggatgaaatctttgaacttattttcctgtatgttgtggtaggttttccctgatttatccccaatattttgtttgtcaacccttctgatttgtgatagtttacagtggtactctgtggccccataaagatcacccatatcactttggttcatttgtcaccactagtgctcatctgccacgttggcttcctgacacctgaactccttttccacagcagtgcttaatggttaatgtgtactctgggaattctggtttgtttactggttagcaaattaatgacttgagaaaggtaccttattgagaagcagttagttcaatggagattgccaccatctctacattgacagcaaaatggctcagtgtcttcagcccttgtcttcctcctgatgttcagacttacctattcaaatgcgtgttttctgatcaccttattttcaatgttccaagagctccttaagactattatatcccaagttgagctctgtatgtctgatttgctttcctctttccattcagttactctcctttgtatttcctatcctgactaacagccttccatgcagccagttcccccaagcaaaaaacctggaaaagggatcatcctagaattgtcccttcattcccctcatcatcccatctacttaacgactaaattgttccactttcatcaagtatttcttgaatctgtcaggtttttaaagttctattctgcttactcattgtctctaacttgagtcaccctgccactagtttcactctctttttttcactctgagctcaactgtcaaagggacatatgaggatgcaaatctaaagcatataaaaacgtcccaacatccttatattctaccctggaaaaaattctttgagatttcaaatcttccatgacctggtccatcttgacaatttcatttgtcatggcgtcatttttcagccttcctacatataaaaggaagtccccttatcaaacttgattagggtaagtggataggcggtttttggaaaaatattgtaaaattggagggattatataaatgtgtttacacatcttcaaacattttatttttcttagaatatacaagtggtcactcatttacttctcatttggtatggggtccgagacttttcctggagtaaaagcccacaggttgaagttaagcatattactttttgcataaaacacttctacatttcataatctgtgacttttagtttggtttctttgaattacagtcagatttggagatgctgaaaataatctcaatgcaaaatacctccattttttggggattctatccctcatacccaatcttaaacagttgtcttacctacatctaattcaacagcaccgtggttttttttttttttttttttttcctcactctgtcacccaggctggagtgcaatggcatgatcttgtctcactgcaacctccgcctcccgggttcgagcaactctcccacctcagactcccatgtagctgggactacaggcccacgtctggctaagttttgtattttcttagtagcgatgtggtttcgccatgttggccaggctggtctcgaaatcctgacctcaggtgatccacccatctcggcctcccaaagtgctgggattataggtgtgagccaccgcatctggccttttttttttttctaatcacctttatcaagtcttccaaagcattcaatttagtattcatagaaaccacaattctcttatcttttcatttctatttcattagttttcatgatatttaattaaataggacaattttaataataagaataacttgcatagccaggtcaggaaccacagactgttgcctcttggagaacatactctcaaatggtgggagccaaggtacatggtaccagaaaggatacttgaacacctttcaaaaacatcaataggttactaatatccatcaataggtttggagtgggaattgggcagtttatatgtagaaaatgaagagtttagggtaagtcaatggtgcttgcttaacagagcctttttatactgaactgtgtatagtccttcaatgtaggccattttttcttgcttcagtgattttgctcctgtcactttttctctctggcatgtccatttactcttcatttgcctcttctcatcctttaagacccatcccagagatcacgttccctaacaaactctccctaactcctactttcccaggcacataaagttcatggaaggccacaaataaagtacattcacttgtatatctccacacagtggtatcatcattaccagccaatgcaacaacatatttggtgccagctagtctgtttcactagaactagccaagttgaaaaaataaaatatgacataaaacaattaactatgaagctgatttttcatagtcttttgatgaagaattatgaatgcccttgaaagcttttcaagagtcatcagagaacagatgggaagagaccagcttttccattgacacctgtgaataataatatctgtatgattctctctgatcaatctaaaaatagctctttggtgatatggattgcatctaaaacatcttgtggctatatgtaggatgaggctaaaacattcagtttcagggctaattcctgcttaattcacttaaaaggtattagttgagatacagtgagagtaggataaacaaatgtacaaaatgtttgaatcaaagagctgctttttgccataactagctaaataaattgaagttacttgtctcttaaatgtactaaattctgaagaatacctaaaatattattaaccaaactccttccatttttttaagactagaagggatcaaggtcaatttctagaattgcaaacgtatccatggaaatgtgataacatgataaaaacagaaaaattggtctggctctttagatctatttttaatctatataataatgtcaagtgtaaagatttaaatcttcagtttaatctgaatgtgaataaaattcttacgatttaaattaagaaagtacttactggccatctacaatatatcaggctttctggtaagtactgtgggttatagagataacaataagagagtcctctgccctcatgaagcttttaatcttgctgggggaaaagcatatgtaaataggtatgatacatgatatatacatacaatattacatgagtgttataaaaaggggcaagaaaaccttaagagaataaactgcttatgtttgagaagagcaggtcacaattcattgaggtaatagcagttaagatgagtcttaagggatgtgtaagattttgggaaaaaaaataaggggaaagagaattcaaccaaaggaagcggtttttttttttttttgtcttgttttttgttctttgtttttttttttttgcaaaagctgaagaacagaaaacttcaggtcattcaaagcttcagacataaacagaaatagtggaaattatgaaaaacagggttggaaagataggtcagaacagattctatgttcaattcttttgctactacgtgtggccatcaaaggtaaggagaaggttggtaggaagaaattgcaagtgtataccagagaatcctgatggacaaaactgggataaataatgcaaaatctgatctagagtaaggactccggaggcagactgcgggactgcatcctggttcaaatacttgctggctgtgcaatcttgggcaaagagttttatcagtctgtgccttcgttgccctcctgtaaaattaaaaggagaatagcaactatttcatagagttgttataagtattgagctacgtaaaacacttggaacagtgcatggcaatattaagtgttatcaccatcacttccatcaccaccctaaccgtcatcatcatacaaaggtctgcatgaggtactataaaatcaaatatctatggaaaagcaattaatataaatgagcaaagtgggacaggtgctgcaaactgaggacaaagcttgcttaccccaggcaatgcttctcaaactttaatgtgcccatgaatcacttggaaacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatcatcaatggatactaaagccattagatgatttattaattgcgaagaaaaaatgtgacattataatgcaagatctgtcagtcaccacctgaagcaagtaataaaactttgcagcatttagtgagactacttcatatgatgcacctcctgatgtgacgtaatacaaaatacacagcatctcatatgaagtattctcgccaaacatgtttgacatgcatctcttgaagtcttatttagacctaacttccagtttactagaaattcagagactacagaacaagttaaatcatcccatcaggggaaaaaaaataaaacaaatcctgaaagatgagacattttttgaggctagcgtcctggacattttcaaatttcaatatcggtgaaaaaaatgtggaagggctattttagactaagaaggatgaaaaataataataaccaaatgtaatgcatgagccatgataagatattggtactaactcccctgcaaaatataaaagacatttttgaactattaaggaaatatgaatatggaatggatattaacaataatgcagtattatatttaatttggaggagagcataataaacaggcatggttatatatggcatgtctgtatttcaaagcgacacatgctgaattatttaggggtaaaatataatggtatttataacttatttgcaaaaatgttaaaaagtgtgtgtgtgtgtgtgtgtgtgtgtgtgtgatgccctatatatgagagatacagaaagagggtagagaaagcgagagaaaaaaagcatatatggcaaaatgttaacaattgttgactctaagaatttagggggaggaaaacagtgtaaatgggcatatgttttgcaattgtttcaatttttctatatgtttgaaatttttcacaaaaagacttggggaaggaaaaaattcaaaattattttcattaaggtaacacttaaattaaaaccactattccttaatgcatattagtagaataattgccttatctgtgatatgggataagcaatatcagacttgtctaaaagaagaaagaattataatgttttgaaatcttaattattattgctaaggattatgattcagaggttcctcaatttaggaattccacttcccactgccttgcttccgtctcccattcaaacttttatcaactgacattattctaagtaaaatcctcttcattatgttgtcagcaatccattgcttgaaggcctggctccccagaacccctcgactggtatgtcttctcctagaatactccagaagaaaaggagtgtatgaagatagtgactgcacattaaaatgactgaaaccatagtaaattaggatgagattctgggcagataaacagacagctggctaggatcatttttttatgccttggacttctttggcaatctgttgaagcctgacattcctcagaataatgttttaaagcccaacaataagaccctgtagcacatataataagtactgcagttttgaagtagtgataagcataaatgatattttgatatatttattataactgtaatgagatgtgtacatatctgtgacttcataggtactgattgtactactgtgatttttttgcctactttcaaaatgaaaaggaatgcttaatttcagttagaggttagtaaagacaaataggtaattttcttctccagtgaagagcatggcgccccttgctattcatggacgcttgcttaaagacttgtacacaggcttgctttgtatcaacctatgacttccccttacagccgatgataggtttttatttgcacctccttcgtgtacaaagacagttttggtggctacgccatcattaaactcattattatcatgcttaagcctatagatgtatccagttcttctgttacataattgaagctgtagtgaattgtctatcttaaactgcatcgctaactgactacatttcacacttcatttgcttccaacatagactaaccttcttggatgtccactattatttgaacttttgagattttttttcctatttctaatatcttaaaatttcagaagacttaaagttttgcaactacagggctccatatagacatctagcttgaatttatacactttctttcattgatgtccctggactaaaaaatgttaaatatttctaaccgctgtacttaaagtccattacaaacgaagactactgttgttaagttgaataggcatcttatatatttttcaccggtgcaataaataacttctattcccttctaacatctgcttgcgttgcactgagagtacactattgattagcaataggttcgtgattacagcccttctataattaattgttaggttaacatattattcataaaatattattttattaatttttacttgatttgctactggatgcttagaaatagctatgagtatattggtagaaccagtacttatattttattacatttttacatttcataaaatttaagtgatataaaaatcctgaggaagtatgccacaaaagtggtctcagtggaaatttaaatatgttaacatttatttttaaaatgtagcgtgaaatagacaactttaaaagctcagcttaaaaaaaaaactcaaggaagctgaacttgactttttaaagcactgaagtgcaatatttaatgtaggtcaacatgtttaaatgggaaaatttttttcctaattacagccaaatccctagctgtaattaacttaaaatttgtatactatttcacaacagagtcagcatataccactttcttataaaattagaaagatctaaaattttagagcttatttggtgaaacaggcatattgctacatctttgtttataaattataatgtgcctttagagcccaataacagataacaagattttgaaaattcaggtgaattagagttatcagagggaatgttaatacactctattcaaatactatatgagtaagacatttaaaataggaaacaatactttatatattatagaaaaataatcttccagtcgatttaatccactttatgaattctctccgtatatatatatttatagtatggtattcaatttttttaattttctcatttcttaccatcttaatttggattagattgagcctagttcagaaatgacattatacaggtttatacctgttcatagtataagcacatcagttatctaaataataaaatacttgtatgattaagagaagaatttcaatctgggaaaaaagtatatgacttacctaaggaagtagtttaactacaaagtttagttctttattttatctatctataatcaagaagattttcaaaaccaagacttaattattcaaaatatcttttgatgaggctataattctttaactttggcaaggggtgtgtgtgtgtgtgtgtgtgtgtgtgtgtgtgtgtgtgtgtgtgtgtgtgtgtgtgtttaggtcaactaatgtgtttattttgtacaaaatatgaattgtatctactttctgaataatgtaacatgaataaagagggaaagaggaggtgggcaaagacaactgacataattccaaaatcttctttttaatacatcttaacgaaagatattcatcaatgagttgttctagcttcctgaatattaaaatccacctattatgtggatgatgggtgggatgcaagagcttggcaaaagaacgaagttttcattgttcataacaatagtctcatttggtaaataaaggccaagtcttcctttacgaaacaagacacattaacatcaacaactggaagcataatacaaaatcccatttataaactctctaggctttccaactgcagcagcacgcatttggctttctgtgccttcaatacattccaagggaaatttaaatgatgattgaatttgacagtaacctttttgaggttttgttttccccattaaacttgtacctctttggctcaagttccccttcaagaatgtattcacaaatgtggtgaaactagaggtaagtgacactatcactttttttagcttcatagtcatattcatagctatttttaaaactaagcaaagatctgtctttcctacaaaacaatcatttataattgctttctaaaatcttcttgaaaaacaactgagattcagcttgttgaagttaaaatatattgaagatattcacctttaagcaatcatgggtgatttttaaagcaaacttcaagtttaaaatagcagaaaaccactaactagccacaagtatatattttagtatatgaaaaaaagaaataaaaaatttctttactgctgttgattaatggttgataggttctttaatgttagtgcctttcaccctgcttataatctctcatgaaatattcttctaaagaaagcttaaaaagtctgctaaaatgttttcattcctattagatctgtcgccctacctcttttttctgtctgacagctgtttgcagacctcctgccaccgcagattcaggcttcccaatttttcctgtagaatactggcatctgtttttgaggattgctgaattatttcttccccagttgcattcaatgttctgacaacagtttgccgctgcccaatgccatcctggagttcctgtaagataccaaaaaggcaaaacaaaaatgaagccccatgtctttttatttgagaaaagattaaacagtgtgctaccacatgcagttgtactggcaaagaaagaaatacaaaagctccatgtgaaaatttccctatgaaactgacatgcccatatccaaaggatacaagacagaaagacaccttttatgtgtcagggaaaaaagcaccctctcggttagctccagtttttatttttgtaagcttgtcagctagaggatgttataatgtcctacaaatcaattagttggaaaccttttcaagagcaaattcgatttcttgtccccacaaggatgttccatgtttaatagtctatgaaatgttgtaaaatttaaacatgaacaaagtatttgggtttcttagtgatcgtggatacgagaggtgaaaaagaacaaacataggttagtcacagtattaaaaaaaaactctagagatatttaaataaaattaattgctatattagaagaaaattcatttcaaattctgtctgcgtcaatgtattttgcattagaagccacaaaaaactgagaattaattgctttcaggagcatcccatcaagatatccctaagctacagtaataaattttaaaataatctatagtcaccagagcatttttatgattgtcaagcttaaatattgtttacttttttcctgaatgaaattttaagagtaaagtatcagaaaaatagctcaattgaaaaggagaatattacaaccaagtacacacaaaaacaaaaatgctttttaccattaaataaaaatggcaattacgttctatttaactttttaaaaaagataatctagaatttgtaaggccattaaaataacatattaactaaatacgaaccttagaaaatgaaataatatctgagaacttgaggtacctaccgtatttaaatctgaatgactcaaatccttatgtcactgacagaataatgtgcgtatgtagaaaactctcctaatagatgtgattcatattctctaatatttttgtattctcctactccttgacacaatagcaagctgacagtagaccccagtacatgcttcctaaatgaaggaaggaatgcatgttttctgagactgaggtaaagctcccttagactctcgtttcacatacatttcttggcttttttctttttctacattcaagcaaaattattttcgaatactggaaattttggtagcatacagttagcaattaaaatactctgtaaatcagcaaaccggtgacacggtgcctcacaatgaatataaaactatgcacagttactgaactattcacaagctgtcctggccatactctcttgaatgcccatgagatgtgctctagtaaacatgtgatatttccttgtaactagttggctttgctccattgcttacatctcactctttaccacctgttcagatcagcgttgcatgtgacagtcattgcttagtaatagagacaccagtcataacaaactgtgtctatatattaggttggtgcaaaagtaatcacggtttatgccattacttttatatcataaattctttgaggtcagatattgtgtcttattcatgatagtttcctattgtttagtacaatgtctgatgcatggaaggtttcagtaagcatttgctgagtgaacgcatgaatctatgaataagggaagtggggaagaagcggagggaggaagagaggaaggaatggaggaagaaaagaagggaggaaaggagagaggtagaaagaaaggaagggaggaagttcaggctcatcatcaccatggagtcattagtattaatacccattactgatcctcctagagattcaaataaataagcacaattttctaggtcttaggcagtacataatctagttgaaaaaataagacacagttgcaagtgataatttgttatactacatacagtaggataaaaaaaaagcaaggtgatcaacaaatggtaggccagaagagggatgatctcagtgaaaaggatgagcggaggagacttctgggtcaatttggaatttaaagaatcgtagaacttaggcatatggagggttagaggcagtgagagtacggcagaagttaaagcctgtggtgtgcaatctccatgatgtgaccaagagcataaaactgggctctatgccactgtatgagagcaggcgttaggggaggagtacagccctcggtgtatattggggcctgggcagagaacttgaggcaacgtaaattattaaggcaacatgaactattacatgagaatcaccattgttttggaataaactgcatcgtgcaagcatcagtgactactgaaatgggaaaaaaattttgcctaaaacatagatgtcagggaggtatttagagagtaaagaccatggctcttatttgttccttcaagagtgtccaatacttacaactattacttcatacttttaaaaaatgcatgggcacacatcagatgtataccatagcggtgcttcctagactttaatgcgcatacaaatctcctggagatcttactaaactgcaagttctgctgcattaggtccgtggaggcaccaaaattctgcatttcctacaaacttcaaaaaaatgccaatactgctggtccaggaatacctctttgagttgtaaggtaatggagtaaatgccttttgagtctttgttaagcaatcaaggaattcttattgctgcttataatgctataaactaatgctgcagcatttttatctcagcctctttgctttgtagttttgatcttggcacttttgcttcatggctgatggctacggtgacttttacaacctaattgtggaatcagcaatggttttattatttcggtttcccaaataagagatagaattgaacagctaagagtgaagcaataatttaaaattgttagatctaaatctcatttgtatagaatcgcaaatcagggctttcaggtttttttaattttgtgaaagaagagctcattacacagtctactgcatttgtatgagaaggttttgcaaccaggagaaatatttacagtgcatggcctgctcaaggagagttttcagtgataaagcataagaaagaaaaataagggatcaaaacagaaagtagtagcttgtatgtggtgttttctgagctggaaaagataacactgggtttacaaaattaaatgtaaaatctcaatcaactttattcacacagtgaacaacattaattaattttaattctatagcttctaaatattttaagtactgaattattcattaccaataaaatttccaagctttgatatcatattaatgtactgctgtcataggcattcttatctatttctctggcaattaacatctagtcttggttctggacaaaaagaaaatcataattaaatctgttggattattcatcatagttagaaagcttattgtgttttgattccaatattaagcattcattcttaataagaagtgcatatctaactcccgtggggagcttttcaaaatataaaagcccagaattccattctaagtctactgaatcagaatttctggggacaaaggtatatgaaagagatacactaaaaaagaaaggggaggttacaaacatgtgcagagagttgggaagcaggaaggacatgtagaattactatattattttcaacttctcttctgctttttaagtcaaaagctgttcctaaattatagaaaataacactgttacatatctaagtccttcaagtctggtcaaattgggggaaggaaagaggaaacataggcaaagaaagaactgctacatttttatttttatacagggaaggatataagaaaaagaaaccactaccttttctatgaaaacattacgtacatttttttaaaagtctatttgtaaaactttccaaaactgcatgaaaacacaatagatgaaaaatagaatgtgacaaatgaagaaaaggaataagctaagaagcagttataagaaattgtacaatgacagattggatgaattatgtaggaaataaaaaattggcaaaaaatcacaaactagggagcaagataaaaaaacagaagagataaaatgcaactggaagaaaagataaatacagggaaatagagggaagaaaaaggaaacttcattgaacaaggagatgtttcaagaatccaatactgagatttacttgtaattttgttcatgaattattttgagacaggtaaatcattaaccgagtttactgattggtcaagagaaaagatgtaataaaatgaaatttgggagagttgtgaaacagacttttatggtgcaatttcctacaaatatggtgctttatcttgtttttttatcctaaggtcattctcattgtgtctcttcgtcagtgccaagaattcaggagtttgatatacagtttctgatacttttttcaatgataaataaagcaagttaaccagtcatgctaattattagaaaatatagccaatactgttttcagagattttaatgtgcttcagcaagtttctttcaacttctatcggatgatggatttttgtaaagaagcaaaataaatgcacaaatactcaaggcatatgctaagcacagcaccaggacccattcaacttagcctgtccatagactgagggattccgtcttggtggaaggtctgataaccttgtgggagcacctgaggatagtcagaacaattgaaagatggctaaaattggggaaatctagcagttaggaaaatggagagaagggcaaaatagtatagaaaaaaaaaagagtggaaaaatagtatagaaaagcaactaggaaggataagaaaacagtgaaaaatggctgaaataaatggcctttttttgagtaaagaaagaatgaaagttataggaggtaagaatcaaggtcaaggagagctcagaatgagaaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcctctgaacacattaaatgtttcatcgtggaacatattgcacgtaactcaaaaaacactgtctcaggacgtgatattcgaaaggaagcataggtcattttaaaatttctaatttctcttctctctagaggtattatcaatttggagccacataaatacttcttcaaaagccatttggcgggtagagggtgatacaatatgtatgtgtgcatatagaaaaagccaacaaaattgtttttcaaaaataagacaatgtgcaagtcaacttgattatacactgtaaatatttgatggaagtatctaatgtcattggttctaaaaccctgtagttctctactggtatttgccatgcctatattttcactctgtaagtcaattattgattggatacctcctattagccagacactgtggaaggtgctagtcatcattctctgctggaggatgaatggattggaggagcccgggaatagaagtaaggagaccaagcaggagatatcatggtagttaaagtgaggaaagatggtcgcttggattgaggaggagtcagtggcagaaatggagagaagtgcatggaaccaagtggcatttggaaagtaaatacacaggacttaatgcattggagacagaaatgaaggagagagtatcaatcagacagttgaagatactggtctggaactcagaggaaatattaggactgaaaatataactgagagcattattggcagagctatgtctaaaatttatgatgtgagttttgctccaaatgtgtttgagtcccttatttttattgaaacgattctgggcaaactcaaagctagcaatcataatccaaacatattttgggaatccctgagtatctgcatgatgactaattttgtcattattgacatttgctacatctaatatgtattattttcatttgctggcagagagattaatatcataattagcataatgtagaaaattgagaggccgtatgattccccacaaatttgaagaaaatagaatatcgttttgatgaagctgcttgtgttttcctaccctaactcccacccacctattagttaaaaaaaatggtcaaaggtgatttcaaaatatgttttgagaaagtgttgtgctttaagagaacagaattaagcttgttccttaatacacttctattctgtgttcacaagaattccatgggcctttgctgtggcatagtctttaaatgctgtctaatgtaggtaaattgttcaatgcagtaagtgttctctttagtgtgactgactccaacaaatatttaatttagggtaactactaggtgtctcaagttttacaatgataaataagcttgtattttcttgtcaacactctcaacttaatggggacaccctagaaaatgctgtgttacaatataactatggcgattgctttgagaacaagatagatcaatgaatttggcgaaatggtaaggaaaagaaacagacaagttgaggtaattactattataaaggccttaaagacagtcttttccccatttcctatatcaccaagtacagcgctgagcactgctcagcttaataattgcttaagaaatatttgttgataaattgagcagaaaactaagcaagatattataatcttcttgattgctttctcattctggaaagggtcaaaagtaactttttgaaatacatacaacagcctagagtgaaaaagagacatttaaaaataattgtgtttttatcaaagtttcatctcctaccacaaataacaagttattaaggaaagctgtcgtttctcaggctcttgagaatgggaaggcctagaaatacgataaagagggatcaaagcagatctctgtgtctaacatcaattaattgattttgagcatttagcttagattacagaacccccaagacatcaactaacaatccacatctaagcacatgttgggcatcactaagccttatatgtccctcttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacctctacttatgtaatcctttcattccagttgactagaccatgagatccatgagagcaggaactgtaatcttttctcactctagtgcctagtaacgtgttgctacctggcagtgctcaaaacatgtttgttaaatggataaaggtgtgccccaaatactaactctattgtgaatacattttcaagcaaaagttatctatcctataaattgggaatacattttcaagcaaaagttatctatcctataaaatcatactgtacttgaactgtatctacataatggtttttcacagtctataaaaattaaattttgttattattagagacaaggactcattctgtcatgcaagtttgagtgcagtggtacaatcatagctcactgtagtctccaacccctgagctctggtgatcctccacctcagcctcttgagtagctgagaccaccggtgcataccaccacacccagataatttttaaaatttttttgtggagacagggtctcacttttttgctgaggctggtcttgaactcctggcctcaaacaatcctcccaccttagccttccaaagtgctaggatcataggcatgagccaccatgcccagcctaaatttcattattttgattgaaaatttatgattgtctttatttcagggacattgtcttctttacctttgaggtctccactatgctcatcagttaatttgttctttttactaaatggctaaatgagtgactgagtttcttttactggtatgtggtgaaactgcagaatttttatgcacgttgaaagaatctctaagagcatagcacatttggtaaaaagcatgattaaattctatttctgtacttttaaatacctactaggggtctagcaaaaaaaaaaaatagtgctgatgctgaagctggtcaaagacaattcaaatgttctgcacttcatattagtggtggggttgccaaggaacagagcttttacaaagctaatgccctgctgctcaggcagcaacactgcattctagtagactcttcagataaagtaaaaagaaaagaaacaaaacaggaaaatgtctgtcattcccagtcttcaagttatatgaatgacctcaaaatgatactattttcacccaataatcataaaggtaataatcttcaacacacataatctatatgaatgtccaataaatccatgaaaagatgcttaatagtgctagtaatcagaggaatataagttaaaaccacaacaatatacctacatattctgtaagatagcaaaaattaaaatgactgacaagaccaaatattgacaaagatgtagagtaactggaactctccatcatcactggtggcattgcaaaatggcacaaccactttagaaaactgtttaggtgctgtttgacaatatctcataaatttaaacatttcacccagccattccacttctacagagttactcaaactaaatgaaaacatatgctcacaaatggcttgtacacaaatgtccacagcatcttattcataacagccaaaaactgaaaaccacctgaatgtccatcaaaaggagaatagataaataaattgtggtatatctatacaatagaatattaatcatcaataaaggaatgaacagctgatacacttacatggatgaatctcaaaagtagtatgctgatcaaaatagtacattttgtatgatttcatttatacaaatttttaaaaagacaaaactaatctatggtgatataaatcagaagaataggtgcctattggggctgggaattgactggaaggtagcatgaaaaagctttctgaggtaatggaaatttttattttattgaggtgtcactttatcagtgggaccacttcacaaaagttaacagattgagcatttaatatctttactaacttatacacctgccacagtataagttactgtcacacccagtaagaaagcgtggaaaatatattagatggcagaatctgaatattatacaaagtatcttgacagattgaagttctcaactaaatatgacaggttgaaatgttatgtaagaacaaactcttcctcctctcccaaataagtctgtttcatcttatataaaattttacctcaattaagaaataaaaacaatatcatttttaactgctctccttacttacacaataccttagccatgctaacaatcagggcatccagcaaatctaagtactttctctctcttacttcacacagtacatatggacccttcttatgcaagaaaacaactaactgaaataggctgattgccaaacctcagtcatttgcagacagaatttaaaagagttcagaagactaatcaggttatacaggaacagacttcgtgaaccatcagggatattatacaattcacccttttatccccacacacaatgatcaatttagacaatctataagacgagtcaagtggcatctgtctttcaggaacacacgtgtgtatgtgggggtgtatgtttattagattaagaaggaaaaagcgtagagattcaacgatcttgaatttcaagagaaaatggctcaagaaagcctgtaaaagctctttagaataaaattttgacaatataatggcaaatcatcccagtgagtataaaacaaagatgtgtgccactgtatggacaacctcaaaggtgctcagattctaatagagtatgaacatgggaagaaacgagggacagagaactgagggcaaatattagaagaacaatatagaactgtataaacagtgaggaaaagctgagcttggaatgaattgaggctcgtgataatggtaaagacaacattcagggcctttttacttccatttggaggaagaagaaccagaaagacgaaggttcactgattggggcagaagggagaaggttagggatagagacgacacagaaagcagcagtgtgcagctccttttgcttgtctgctctgtcaaggagaatgttcatcagactggaaaaggcataaccgtataagggaaatgaagcccaaaataggtgagggaattttaaaagagcaccttgctgctctaaatgagctaaaatctctggccctggaccaattatattctagggaaatgagagaacttgcgcaatacagtcctaccccactgtcagtggtctttgaggaactatgttaacactgcagatgggcaaatgtcatctcgatttttaaagacaggaagaggtcactgcgactgtgttccatcaattcctgctaaagagcatttctgaatgatggaacaaggagcaaacaaacacttgttaacaaagacaacgtggaggcagctaatttgggtttgtatgacaactcgttcttacaccagacatgtgtgcctgtgtttgcagttgaatctcttttgcagtatgaaaattgaatttcacatttctaaacaacttaaaaaccacttctttttttttccagctaatgaaagttaaattttcttaaaatgaaataaccatataaataatgaattgtgttctgttgtacaaggagcagcatgacatccagttgcccaccacctgaaaaagtttgaggtcctctggcaaataatggacagagacaatgatcttatacgtgcaccattttgtgttatttgacatggtgacaatgggtctcctttctacaagaacagaacaagaggaaataagattgcagagtagttggggaacctacacaggagggagtcttccgaaaagagatttagactgtatcaatatccagaaaaatgtcgaaggtgatttttggaaaatggcatcattgtttacatttattcttttggttttcttctatcacttttagtggatttttataatgaagagacatacgtttatgatcagaaaaaaataaccctctacccatttgggaaataaattgatataatcttaccaaaacaaggtatttttttctggatttttttattcaagagtgagagaatagataaaatagtctttcccagtactgtatattaattatttaaatatgatattttaaaataaagttatcatactttatctactatggtatcagcacctgtagacataatttactaccatatttgcattagtacatattactaaagtttttcagagatatggccatatatagtgggtaaaagataccaaaaatcataaataacattttattctttctcaagtaacattattcagctcctctaatataatttcagagcttttgttaatggtatttttctacatactagttttgaataaattcatgtctaccatgaactatctagggagaaatgttgttaaaaatgctgttacaagttccataaacttagtttacttgatatcttataaacatgctgccttttgcaaaatacagattactactgaaatcaggaaagcttagaattattaagacagacgtattgtagggaaataagggaaaattgctctaattttgttctgacattcagaatataaagataataggtattatcatgatgtcaacatgctccatcaaaactcccattcaataccattctttttccatatatacttactttttttttcctcatccttggccttaatacaaaactcaatatttcatttatagtttgaaattttgttacatactaccctaatcctatgtggattgaagaagggtataaatcaataaaacttaaaactgaattttctcctttaagcagtttagatattttaattagtaaacacaaacaaataaggttagctatgtattgcacatttaaagaaatatcacactgtcaatgtgaaaagaaatttgtaaggaaaaaaaagaacaaagatcagtctgggacatctgcaatacattccagattcaggaacaacaagttaagtatctacctactcatcttttctggcatgatcttctgttaaaacaaggaaaggcagttaccatacagaaatgttgattttgtcagacagataaagacatcactaatactatgccaaagaataattgcaattatcttattgtgataatttattgctttcatatacttcataaagtgctatcagatgattgttccatttgagatccacgtgaagtatgaggtcagaaaaatgtgttattattcctagggtaaagacgaggaattgggggtctaaatatttgtccaagttgtcctgcagataaaggtcccaggaccaggccccagattgttatcacatttcagtgagattcccattattcggtactggctcttttctgactcaaatacttagatattaaagagatatatgcgagacatgaaaagtagaaagtacaaaaaaatcggcaagttgtacacttttaaattattgtgaaaataattaaccaaatacttcataattatagatgtttttggtagaaaaaagatgattcgatactcactttcctattaaacatctattttgtctttcactttgataatgctgttatcttcagttaaatataatcattatgtgaataaacaatgtggatcaaaaaagaatgagaaatatcaacccagaatatgtttgaagctgatttaaagaggacaacagcatccctagattagattacatgtttttgtaaagctgctatattagaatgtcatgctgacatgattcttgataatgtatttaatgggtaaagtatgcatagtgaacatttgtgtagagttcatcacatctaattttctgttttcttttgatacacgaaggtgaatgatgcaattgtggtatttctgctgttgaacttaatgaaaattctgtccactatcaatcaaatagatcttttctcttgtttgttgtccaaacaaatatgttcaaaagtaattcatttttattgaaaagtcttgtactcacatgatgaaaaaaacacaaacaaggctttaatttatttcacatgcacttgcttgcaagctatacactggagaagaggggaagtttagttttatatttatgtaattcaagttatgtagatagaccaggtgttatataaatggacagatttttaaactagtatgtttcaataaataatatgagccaatcttcagaaatgaatataaacatgtggcatccttctctataaaaacacaaggttgaatggggctcatctgaagtgttgctgcaacagtgtgatgtctgtcctggccgagagtatgtgggatgatttatctcaatatgtttttgcagtaacaggtcatactgaaacaatgatgggacaacaaatcacaatgtatgccatacaaagaaatgatatgggaagaataatttcattcccaagtatttaaaattgatactctattttgaagatcaccatagaattagaaacaatgtaaaagaatagacctggtaataataactataatttctttcaaaaagagaattcataaacatagaaaccaaggactcagagaagaaccacttataaacattagaatattaccttctgccattcctaatttagcatataaaggtaactttttaaaatctctgcttttcataactgagagccagaaacaaaacgtctgcatgatgattaggtgttctttgtatatagcaacagtatccccttgccaattttaacaatattaagaaacatatgccccactctccagaataaatagctgtgtagaagaaaatgctttgaaacattcattgtcttcttaaaatatgaaaatcaacatttaggaaaatatttatgtcgcttctacataatagcctttgggtaagtacagattaacttgacagaggtctttcacgcttaaacatcgacatttaaattttgattgacaaccaacagtaacgagtaacgctttcattttagatatttaaatatacagaagtaccatttgcctgcaagactgagcaaatgaattaatttgttcagtaaatatttattgagcgcattgcatcctgcatcagacagttcctgaccttaggcatttcattgcaggtatagacaaacaataaacaaacaaagatgtacatacacggaataaacacatattgtggtaatagggacaaaagaaaatcacgggatgctttcacagagaataatggagaataatgataacggagactaataatgctcaatagttgaggatttgcaagattatggtgtaactttagataaagtgacctggaaaggctttggagatgaagttactgaaacgggagatgcacaaagaagaacagaattaactacttatccagatggagaaaacagcatgtatgacgctcccgagtcaggaaggaactttatatgcctggatataaagaagctgaaagaaaacgagaatggttggagccccttgaatgaaggggagtgtggaatgaaatcaacttcaacatacagattcatgtacaaggatgttcactgcagtgaccaaaatgtggaagcagtcccaatgcccaataatgggagaataattaattatttacaatcacatctgggagtttactatattgtattgcattttaaaatgacatataaaatttaaaataattctaattattaaacatcaataaaatattaaataaaagatgataaaattttttttgtacaatactacttgctaatgggacagaactcaagaaaacatcaaaaggtgtaaaacccattaagaaggcaacctatgggagaaagactataggtgcttttttgtttgtttgttttgttttttttctgagacagagtctcgctctgtcaccaggctggaatacagtggtgtgatcccggctcactgcaacctctgcctcccgggttcaagcgattctcctgcctcagcctcccgagtagctgggactacaggcacacaccaccatgctcagctaatttttgtatttttagtagagacgggattcaccatgttggccaggatggtgtcgatctcttgacctcgtgatccacccaccttggcctcccgaagtgctgggattacaggcgtgagccactgtgcccagctgtcttaatttaatacttttgtgtattttcaaacttttctacactgagctttaaaaagtataagcaaaaatgaaaaacaaagtgaaaccgccatattgcctttgtcctgaaatattaaaaaacgaactaaaatgggcacagaacaaaaactataatattcctatatgcatgttcacattgagaaaaatagtgagacaaaatgtctgaatcctggtaactatgatagaaatggagtgtgcctatatgcacgtgtgtgaagggaaaggtattctctctcgattatctatatttatctatttatcatttatctgtcatctattagttatctatcagttatctatctatcatctatctgtttaccatctagctgtaggtcataaatagaagacattttaattaatatttgctattgacctattctcaaaaatcactactgaattgtttacaaaactcagcatgctttgccaaataattaagacctttatttgtattcatgagtcttaattgccaaacaattaagacctttacttgatcaaatcaagaaaattagcatatcacctcaaacatttaccatttatttggggtagaaaccttcaaaaccctctcttctagccgttttgagatacgcaataccttactgttgacaatagtctccatactatgcaacaggacaccagaactaattcttcctttctaatcgtgactttgtacccattgacaatcctctccccattctcgcttttcccctacttcccccattctttggtgaccaccgtccatttactgcttctatgagatcgatgtttttagattgtgcatatgaatgagaacaagctgcatttgtctttctgtgtttggcttagttaatacaacatatgaaaaaatgttcaacatcactatcaggaaaatgcaaatcaaaaccacaatgagatatcatctcattccagttagaatggctattatcaaaatacaaaagataaaaagtgttggcaagaatatggagaaaagggaacccttatgcactgttggtgggaatgtaaatgagtacatccattatggaggacggtatggaggttcctcgaaaacttaaaaatagaactaccatacgatacagcaattccactactggggacagagacaaagcaaataaaatcagtatgtcatagagatatctgcattcccatgtttattgcagcattattcacaatagccaagatatagaatcaacttaagtgtttaataatggatgaataaagaaaatattgcatatatatgcaatgggatattattgagtcatataaaagaataaaatcctgtcatttatgacaacatggatgaacctgaggatactatgttaagtgtctgaagttttgactcctgaaatgttataatgtcctcggtttaggatattagcttgagtagaatggcaacaaggtttgcacaaatatttaaaaagtgactcacaagaaaaagtgctatttaagccgggcatggtggctcatgcctgtaatcccagcactttgggaggccaaggtgggtggatcatgaggtcaggagatcgagaacaacctggctaacacggtgaaactccgtctctactaaaaaaatacaaaaaattacccggacgtggtggcggccgcctgtagtcccagctacttgggaggctgaggcaggagaatggcgtgaacccgggcagtggagcttgcagtgagccgagatcatgccactgcactccagcctgggcaacagagtgagactccatctcaaaaaaaaaaaaaaaaaaaaaaaaaaaggaaaagaaaaagtgctatttaaaaatagcaacactaagaataatacaatattaaattttcatagtattttaaagcctccatagcatattaatttattcaaataactttcaggacaccagaactaattcttcctttttaattgtgactttcatacattaactccatgaaaaattgaggtcaccttttataccaattttataactttgaagagtaaccagtgatatttagagaaattatattagggcactctcacactcacgttcttgtgctctcatttctctctctgtctctctctctctctctctcgaaaccagagagggagagacttattgtaataaattggctcattacgaatctggagaagtcccaagatttacagtcagcaagctggagacccaggaaagccaatgatgtagttcctgtctgagtccaaaggcatgagaaccaagaaagccaatgacgttaagttccagccccagaactggaggcttaagactcaagaagacccaaggtttcaattcaagctcaaaggcaggaaaagatgggtgttccagctttagctatcaggcaggagttccttttaatcaggctttttgattaggtcttcaatcgattggacttaggtcctcaattgattggatcagacccacccacacaagggagaacaatcggctttgctccctctactgattcaaatgtgaatctctccagaaacagcctcataaacacacccagaataatgtttgaccaaatgtctcggtaccctgcggcccagccaagttgacacatgaaattaaccatcacagaaattaagtaatttgttgaagttaaattgatagacttgagatttttaataacaatcggttccaaattctagcctgatgtgttttttccttttattatattaaatttattgcaaaatgttcttaaagcaaatttggaaaaggctagatttcttcaggtcagaaattctgccgtattcaatgcatgaagaaagctcaaatgaatctatttgacagacctggagcagttattttgtctgatgctaaggttttgatttacaagcgcaagaaaaaattgtctttgtgctttctgattgtggcagccaagttgagtggggaaaaacaggagaaaaacatgctaatacggggaaaaaaacataaagagaggatttttgcaactcagaaatgaacttatatacaatgaagagcctattttattcctaaaataataatctaaaattttattttaaaaatgagaaagcttgagaggtatttattagattatatactgatttcctttttttaatctctatttttaatgtagactcaggggtacatgtgttggtttgttacaagggtatactgcgtgatgctgaggtttgggcttctgttgattccatcacccagatagtgaacatagtacccaacaggaagttttgcagcacttgctcccctccctcccctcctcctttcggagtgcctaattcgtgttggaaatttgctttaatcttaggggaacattcatagaaaaaactgtacaaagggtttctttacgcattctcaatgatgaaaatcatgttgacattgttctgtcattagaagacatgtacaaaaatagtttttgataaactagcgcttaatgtcttcataacgtaagtggaagcgatgaaaatatactgcaagaaactatttttcaaagtcttcgacatttttactttttttcaactaaacacttcagtccttttgggtgagctctttatattatttaaaaggttcttttcctagatagtttatgtaaatgccttttcctggagtaacctttaaggcattatttggaaataacatagtttctcctaaagtatgtctgtttttatccacaacagtagagtagtaggaaagtgtgtgctaagaaagtacaatattctctttgtcactgtacattattgtagttaccatatgagctaagagactatgctagtgttaaggttgcctttatagtatgattatacctgttattttccttgctctaagtttgttggcatttcacaagaaataatacgtacaaccacaaagttaacttgagctgtgattatgagaaaatggtacaataagttaagcaacacatttaaaacaaatagttcaattactcaatttcatgcggtacagttttaacattgctagtacatcctcagattaaatatacgaaaacattaataactcacgtaagcaaggtgtaaggcagttacacatcctaccacgtgtaaagtatgctactaaatctgaattaaaataaatataagattaaactattactttctagtaggttaacactccgtgaggaaacaagatgtaagcatataaaaagtcaaataaagttttaattaatgttcaagacaatagaagacatgtcatatttcaatacctgatgaatttccaaattgattatacagacaaaatattgtagttcagagagagatcttcaaagatgacaaacaaaaggtctacaaaagaataatttatgagttttcctgaaaaccaatacaggttttgagagttgataagacatggttgatgagatgtataagaaataaaaagtgcaagaacacagggggatttatgacgcataatattgagattatattaaaacaggcattgaatatcaggaagggtgattttataccagatcttgtaaatagaggggatctactacaggttttaaggagacaaacgatatgataaatgttatttttatggctgatcacagtattataaatggattggaatggataatgtgattacaaatggaaaggaaagcaggcagaaagaccagaccagtggcaattacaacgtaaggtactatgacttttatctaagaacttggaaaaaaaagaggtactgagaaggaaaagtgtagcctgcaaaggaggagcaaaagtgggtttgaaccttaataggttggaaggaacaggaagtcaattgtggggatgactttggaggggagagcagggatgaatttgcaaagtcatatggaaactgcggtcatacggagatatccacatgtcatgtccaggtagtagggctagaaatacaggttggaacagagataaaaaacaggatagccaaagccagaagatgagatgtaaacaaaggtgaggtcagagtgagaaagagaaaacaataagcctcaactgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataacctaattatttatttctgtaattttgcacttgatatttttttcaatttatatagtcatatatacttttgtagagcagagggtgagaagagatggatataaatgaaaatgaaactagaaataaattaaaattctttaccaaggtaaaaataaatcttattggtcttatgataatgcattgtcctctgtgatcaccaaaaatctacaatacaaagccagccaatctcttgggagagtgtagaaagtttagggaaatgtaattatattttatttgcagaaggaatcaatatggcggtacttttcaagttcaattcaatcacaaatgtaaagaacagatttgcatttacatctaagcagaagcgtggtggattaaaaagatttcaataacatttagtcatctctttgtcaaaatagggcattcattgaacataatgacactcaaggccatccttccaataaattaccctataaaacttccattcaaaatttaatatggtacaggttggggaatataggtaattaaatgtgtcgtagaggtagaaagaagaccctgggtaaaggaaaagatggtaattaagatttgaaagaataatactgaaataaataggttattctaggaaaatcttatcagtatgctaatcactttaggtcccttatcataggaaagaatcttaaacaggtgcttgggacaatggtggtcaaccccttagcggtttcaaatgctaggagtctcatgacacacaggctctaaaccttgattacctttctacaagaacattgttgcttgttgatctccaatctttttaatacgctaatgtcagatggaaacaaattcgactcctggatggcaagcaagctgcactgggattgggtaaggctagaagccatcatctgcaacacagagataagcgaggctgaattctctgtggccttttgagactgtattatgtgaaatgaagaatttacaagcagaaacagtagctaaaaatctcattattaatgacttttgagcagccacggtttctggtttttcatgtgaatctgtaagagacttaacaaagacaaaaatgtgggcacaaaaaatgtagcaaataaacagaatctgggactaaaatagaaaaatgtaactgtgtctcaaaagtgtttacatactggctgaaagagtgaactgtacagggtttgtttaaacaaaagttatgtaaatctttgctcagctggttgctcaggaaagtaaatggaagcaaacagaggaaaacagaccacgggctggaagagtttgtcaagaatgataacgggcattgaagcatcaggatttaaaatgatagcccagcctctgtaaataatgcaagctcttcaggatgcactagagacccaactcgacagcatgataattttagctaaaaacctgctattccctccacaagactccataaactaaagaagaaagctgagggattgtatacacccaaaacgccaactgttagaagcgtgggaaacctggcacctttaaatctctgattttatcccttagttgcccatgacattgcctgggagattttgcagcacttaaactgggataagttagacaattaaagcatctcagtttttgtctaaccatgctaaaaataagagtgacaggtctgaagcaaacattttgtgcctttgtatgcaaacaaaattcagttgacaaaacacaaagtacaatgactacgaatgagctaaagatacaaaattaagttaggcaaaattcccatgaacgctgtcccttccccgctaaatattttacttccgccactgaaaccctctaacaccaatgaaataaacataagttggtaggacaggtgagaaaaatcttcttaaggagctcaaactaataaccctacgtatcatctggaaaacagtctggcaagaggccttcttttcgcattaaccttctgtgggctccgcacctgacaaagcatggggctgctccccgagaaatgggactcccagtgacacagactaactggagaaaaattggcctgaagttatacatcagtcatttgcagaacaagacttgaggatcatcagcctttggaaatggttttattccaagttatacaggagtaggcacctgctttatatctgcccttagcactccggattaatcgcacatatatagggaaatgaatttctccctgttgatctcttcattgcaatcttgtgcccacaaaatctcaatggaactgcgctaacaggtttaaaagaccaagtcaggaaattcacttgtcacttggttctcaaagtgaacgcgaaagaaactgaagaattcaaaggggtcatggatatttcttcaaagctccaaatagttgtttggtagagatgacgaattttgagccatctgggcaatacgagaaggctcccctgattatccttccttacgtgcttatcaactcacttgcggccctagggagaggatggcatttccgaagttccaaattctctctgtgtgtatctgtgtgcttgagcgcataagttattacatttgtatttacttacttaaatatttattcatttactgaaaaagggcaagaggtagtaaagtaagtccacagagtgaaaaatgagtaggcaaatttgaaagtcaccagtgattactctattggttgaaaagatgcattatcataatgaatgcattagagataacaaacatatgtacaagtgtcaataggtttgtaggattatggctgattttattcgtcttccgtgcaacttcctatatttttcaaattctataatgagcacttattacctttataataagaaaaaagaaaatgcaaaccaaaattgaaaagttttacattttgtggataatttatggcacatctttggaaattttatgttagaggctttcactggctaatcagaaattgctttatctatttttctttgttgaatggaaagggaggagggagggagaggggaataagcaagggagaaataatagggcaaataactggttccactcaagagcaaattaactttccctcatgggtagtcagtacatgttaattgatgataattaagaaaaatgagttttcttttttgtgagcaccaccacacaattccatattttcatattagctaaaggttaaagtcaaactgatccagtacaactttgcagttggatgttaactacttttcatagaaggggccacattcatggtgaatctcaagacctcgtttatttgttaaatgcatctttgcaactattttctatttctccctataccattaatgacacccacaatagtacacaggacatttgatcactatttcttgcatgtctgcatttcctttgctgagaaatagagaaatacataaagaacaaaaaagggctctaagtcccattcaaaaatctacaaacgtgactgctgaacgccttaacaaaagcacccatgaatcggccatggctttatagctgcgaagggacaacacataggcatggagagaaattggaaaaaaagaaaataacgtgaattagaattctgccaatagtattagtgctaatgtaatcaacatgacataagtatgaatctttgaaataccaaaacttcgagtaggtaaagtggttctcaacaatatctttcttctcagggtaatcatagtgaatatgaggatacatcgacagggaaaagaacagtaggtaatttgagggaattttgcagcactaatttagtctccaaacactgattattcagtggtcattattccaaactgcgagggacagtaatgaatccaaacactattcgaaaggcaaactattacagagaatgttacacccttcctaagttgtgagtggcacagatttatgtaatggcaactgggaacaaaaacagccaaggtcagtggaaacctaattgtagtactttatctagttgaataaaaatccacatttttttagcactgaattttcagtaattgaaaacaaaaaaagtggggcttcaattttatatcagctatgataaaagacagtaactcaaaggcttgataccttaaacttcagggttgtttcctgttcattgtaatatcctcagccttacgtagcgttgcaggcatataaccggtccaaaacaataaaaaccatgttgaattaattagtgagtgagtgaacaatgaatgtagaagtagataataagccaggataataagtgatgaactgtgtcagaaccaagatcaacaacaagaaaccaccaacctaactacaccaatgcaatgatgtcatctatgggaagggaagaggaaagggcagtatgctttcatgaatattaatcatttataacgtgtaaactgtatatcttccattccacaatgtgggttcagctcttttcaattaagctttttctttttgcccatataatgatccaatcagaagaaccttagtcaagtgctgctgcaaagaggtgcctgaactgggtgaaccctaaagaaaattctgctgcctgcattggcaagaatccacaagccactctgtatactgcatcttatgtgaatcttctatcatttgtatattcaatcttgaataaatcaatttgccctcttgggtcttatgatcttcgtctataaaatcaggataggtgattgctaggttctgcataatatgaggtttaccttaaggcaacctaggtggcacactagaatcactagggaagctttaaaaaaattcctattctcaggtctcgcaccagaaaaatcaaatcagaatttctgcaggtgggaactaggcatctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagcccagacggcctgacagatgaagttaattttaatattatctcaagaaaagcattaattatatgcatgcctgttaatacgttctggtggagaaaaagatagaaggatgggagtacataatagttagaaaggctgatttgtaaacaaaaataaaaacaacacttcagtacctcttccctattttaaatcacagtccacagttcagcttttccactgggatcacgtcgtaacctgacctgatttccctaacctggtcagattttcttcagaataaaattaataaaagaattcacagaaggcttacaatttcattaaaatagataaaatagttccaacttcataaaaattgtattggcacattcaaagacataaaagaatacttataaattctacaatgcataatctgtgaaatctttttatttgaaaaacaaagtatttagcaaatagcactgtctctccacatagtcacaccatgctgacagaagataaacataaggtcagtaggtcttcctcaaagacatccatccatacactggagacatgatcaattcatctcatcactttcatagtaggggaataactagcggatactttttgcctaaaagcagatttgactctgatgattatcagtacaaatttaaaacgtcaagtcaatttggagaagtgcaagcaaaggcaccaacaaatcaatagtaagattctttgatgttcatcttttaagattctcctttgtactaactcttgactcatactttcccatttaaagtaactgtttattaattgaacattgaattacttgaaatttataataccagctaataactggataagctcttaagggtgtttccttacctgtacccaacgtacagttgaaaattgtggattatttcacgggaaatttatcctgactgaaattgatagcaatgccatacgaaactttcatgaaatttaaatacatagcattgcataaaattaaagcaaaataataccatttgaatttagttttagccttttgagtttggctaatcttaatcactggatgaccactggcttcaacatagaagaaccatataaaaggaaaagtgtacaaattattttaaagtaaatgactgataatttcttacatatcttataaggactattaccttactgttgttgactctacctttctagacatgcctagggactaattggattactttgaaacaatctcttttactgcaaaaggaaagaatttacaaaggcaaagctctatagccaatgagttaagaagttacttactgaattccagagggtgttccatattatactgtggtagtgaacgtggcagtggttgaagtgggttcttagtggatgaaaagtggttctgaagtcgtttagggatcatatgggctaaaattaccatgatagcttcattagcaacaccacctgaagtagaaactgtctctgtataatttcactcagaaccaagttacttttcaactggtctctccccaggatgtgttcctattagctgcaaattcttacaacaaccttatggctaatgaggattcagaatccagaaatggagaatttgttcctctgaagaaagttagaattttaaataaatactgcaacttctggagacttctcaatttaatgtgactccatagtgatcatagtgaccacatgggtgaaacctcttcaaattgataaataaaatggaatttccaattgtgtatcttggacaatccatgcacaattagaaacagatgtaacaatggctttagatgcatgacggataaactataagggccacagttgcatagtactctgactctataagtgtacattttaaacaccttcaatgccttctaaaacataagaacaaaaattgttctggtaactttgatgacttctacttaatcgttgtctttctcagaacaaataggttgaacataaatgcaatgctgtttgataattttgttaaaatgttcaaataaaaaacagtgatttattaggtcccatcgaaaattgcctatttatgtatacaataagcatgagaaatccaaaggaaagcttcatgaaattaccttaaatgctagtttttaacctcctttgaatgagccaatgtgtgttcccttgagaaggaaactttctcaggtctgtgactatttaaaggatttatttttctattgtaagttttcttttcacataacaccagtgaccctggtgatagtaaagctttagcacttggttaaactcctgcgttataatgtatcatattatcatattgtatagaagctgtactttccagtgggatagtcattagccacatgtggctatataaatttaaattaattgaaattaaataaagttaaaacttcagttcttcattcccactaagcacatttcaagttctcaatggccacattatactgcatttctaacattgaagaatgttctataagataggggtgatagagagacggcttctttgtctatctctgccactagtttatccctggtgaggagggcaggggttgagcataatgggttgcatacaacgggcacatataagtgctcaaaaatacagtgaaccaatgaataaatcttgttattattaccactgacactgccatacattaaatacctttcagattaaaagtgcttttacctatcagtggtttccaggggctggggtggggcaggagactgactgcaacgggagtacaaggaaactttttgaagtgataaaaatatttcctattctgatcacggacgtggttgtaggactgcatatgtttgtcaaaactcatcaaactgtacactttaaaaaggcgatttttttgtgcatgtaaattatacctcaataaaacaaaaaggaattggaaagagagaaagtaggcacttttatttgcattttaaaatttcatccttgacttttagagtgactaaaccagatgattactaccgagaaacaacaataaaaatatttagaaatgtaggatgcatcaagtgtgctttggatgtcaagcaacttaggggcacagatttctaaaattgtcttgggttaacatactgctcagggaagacgctagcgggtctcactgggaagacctctcccctccaatctcacccccaccccactgattctctaatcacttttgattttaccatctgttcctcctggcacaacaaaggttcagcaagaaaagtgacagcttcaacaaccttgtcttcaatgatatttttgaaattattggaggtaaaaatcaaatcggtcgatttaatccactatttattgagtgcctattcatgaagtataaattcatggctataccagtctgacatgatttcactaatattatatgaatctaaaacagtggccggaaaaacgtgtgaccaattctgatttccacattgcacaaaagttgacagtgatgcactgactgttctgagaaactttgagggttaactaggaattaggatcatgatttcttgatcacattccctggaaagtaaaccttgtgatagaatatgccaagcaatttggtatgtgcaaagaaatgtaagatttctgtaagccgttcctttctgggtgcagcaggaacttgattggggatttccattagaaaaatctcctgctcatcatgatggtcaaagcctgacccagcttgttaatcttcagagcagaatgcaacgcacaactgtttgcactatccttttactttcacaaattccagtcgctgttgcctctatggtgtcttttaattcaatgtcattacttcgtgtttgttctctatggtgatgtttattacaaagagcacaaagggaacaatttatgcactaaaggtatgtctctgcttatcagaataaattacccgtataagtgtctgcaaaaataatcccatctacttttcttggtgaatattgagtaaaccgttaacagggcagtgaagcatttgattatcttctcaagagaatgaagaccttcatggtcatcctccttctaggactgagagaaatgctaatttctcctcaccaaggttatgaaggtagcatatcatctttacacctagcattagctaagtttctcaatctcaaaattgaagaagtgtttcagtttgttaagcccatgatgaaagcttgtctttttctctcacattctagtctataagtagcacagctatgtctggggtcttagtttttttttagaataaggatgatagctctgtctgtcttcgatgagggcctgagctctaggcctctggatagaaacagaagaggtaatctgtcctacatgtgaattaatgtgaggaaggaatgagaaagcagatataaagtacctagtcactatgatcataatatacaatttataagtgagagctccgatatcagtaatattgttactagtataactcgctgtctttcaactggtttattcatttagctttctccatatatatggtaagccccaaagcatttttttgttctcctctttctcaagcctttctggtcctatggaaagtgttggagtttattgctacagaaattatttctttagtttattgtgatccatagtttggaagttaagtctatttttatagctgtttttctccttcagagcatattttcaatttaacttagcaaacaggcactgtttttaattccaaaacaaagtaatgcataaacaaaaactctaaccccaagaggttcttgatttagctctgctactgtgtatcctcaaccagatagttaaatttaagaaatggaacttaatgtctttgtctgctaggtgaagcagttgaactgcatgacacctaatgtctctgccatctctaatgctactgtttactattcagtgattttagttagccaaataacaaagtttttaagcaattttagcaccctaggcaaatacacccacagagtgaggattttggcaaactattttaatgttacaatggacagtgctggaaaatacgggctcctcaaaacaaaatcttaccttgcctattttagacccagctttttgagagcaaacaatcaagttttgtttttgttagtttcttctcaagacttatcccagggcttttcttataataagtgggtggtaaataattgctgaataaattatggggactcttagagctataaaagatagaatttgggattacctgtgttgcttattagaaaagtttttaaattaactaaatcattttgtgaggatatatatgaactcagttggcctcacatttgccttgaagttttatgttcctgcacttaaatcaacagtgctttttctcattattttcatttcttcagacttttttcccctaacatagttgataaaattccttctgcccacactgaatctttaaaaacacagagtagttggaaaaaacttgtgttttgctatatgtgtataattagtattctgtataaagaaatgaccgtagttctcttgaatccagatgctgcgtgggggttaaattttacagattcagccatttgctaagaaaaataaggtcaaaattttagggtaagaaaataatgagaatgatttaaacttgtatagtacatttcagtttataaatttctttctaaaagtttctttctaatatagtattttatttaattttgacaacaaaactgtgatgtggataggtgtgccactttatagaaaaaagctaaacaaactaagattcaggaagctaagtaacttatttaaggtcacacacctagtttttggcagagacatatgttctggcttcaagttcaaaatcctttccactatactacaattacccctactttacatctaaaaacacttcctagaaatgcgtaagataaaggtagtttttgttttattcctaaaatagattaatcatgtatatcagagatattacaagttgagaattagcaggatgaaattttgacagaaccaacaagatgcaaactgagatagttttataataacagtatgtcttttaataaattacagagtgaatagtttaccaaatgttgggttaaagcaaactttcagccacaagattgaatctgctgttttatccacagatatgtggtttttattgatcttatacttccattttattttaaaatgtacattttatgttaccatcctgggatcaaagtaacttgaaataataggaccttaggtaaataaatccttctgttgggataaggatgaacatgtccatcagagttgtctctttttcctttgctttttaacttgtgttaggcaagtgacagaatatgtttttgttgttctctgatcccagttttattctttgtcactttttttttctgccaaacagatgcagtatgtttcaacagaaagagtgctccaaatctttaatcattatgaaaaacacagtaccttgaccttgtattttaaagttaaatggagtggcattataaaaattaaattggttcttgctcatttccataatatcctctaaaaagccttgcctaacctagagtggatgtcctatttctttatctttcttgatgatctctcatgcctgcaagtcagctcgtttttctttgctgaagactgcaccccactgctgcatgcactctaaaagttccattaaaatctagggcatcatcactcattcttatctgcagcaggctgctgagcagtgccataccagcaactgcatgcaaactagcctcaaaggacaatattagctatatacattgtcattctgtaaagagaagattccacctggatcttaccttatctcccagagcatatctagcctttccaacatggctcccagtgtcagcgctatgaatgggtctcttgcaacagcaaggattacttaaaaagcaatttaccagcaagaaattagctttttataggacaccctttattaaacttggtgtgagatgagctagcatcctgaatttcccccttgagcccactgagaccacgcgggccaaaagctgtttcattttaaatactgtactataaaaaattatacgtattcctctctgatcttgatgaattctttcttgggatggatgtgttattaggataataaggcttgagagttgaacaatgggctaggatttggcactgttcctgttgtcctgaaatgtgaagaaatgttgatgtaacttactcaatgagatgttccctaaccactgggaatagttcactgcctggggacaccagaggagaactacagagatgggggagattggtgaaagagctggggtataaagatacaaaaaataaagaatattaccaccttttccttctttattatatcaaatatcatttttctaaaccaataacagagtacttctgtgggaacgaataaaaaagataatgataatatcaaatatcattattgtcaaacttgatgacttatttctccattttatataacttgtagtaccatcattaagtagtattaaataagatacccatatacatggtactataaataatttcctgacaagtattttacttcttgtctaatgaagtgaagtgaagcactttaatgaagtggtgggtgtaccagtctcagaaacattccgaagactgatttcctaagtcttccaataaactttagctttagacggtgggtggggtgcaggtggttagattgtcagtaaaagcacctaagccctgggtaaattctccagacataataagactgactctgaaagatctttgttgaaaggtgctggataccactctgccatatctatgtaatagtatccattcttccaacagctatatatctagaatcaactctgcaatatttcacatgaaagactctttttcttagagatttagtttccattgttatttcctgtagctgtctggatggtgtcaaccaaggtgaactttggtctaaatgatttttcctcagttattaagtagtgtgaagacaaaaaataataaaataaatgttgggaaattgagaggtatgctgcttcagttatggaatctatttcacataaaatagttattccaagtctaaaaataataataaatccaaaaccaaaatatcggatgtgtagttttaatcaagcaaataaatgttttatagggccttttgattaagagctcacagtgagactttttagtaatttataaccgtgaatactttccacactaatttatcagaagcctttattactacattttccagaattttcaagggggatgtggtgggatgaatagtttcccctgaatagtcacatgtccctgaaaccttgaatgtcaccagatttggaaatagggtctttgaagatgtaattagttaagaatttcaaaatgacatcaccatgaatttagggtgggctctaaatccaaagactggtgtccttttgcggcactattcacaatagcaaagacttggaaccaacccaaatgtccaacaatgatagactggattaagaaaatgtggcacatatacaccatggaatactatgcagccataaaaaaatgatgagttcatgttctttgtagagacatggatgaaattggaaatcatcattctcagtaaactatcgcaagaacaaaaaaccaaacactgcatactctcactcacaggtgggaattgaacaatgagaacacatggacacaggaatgggaacatcacactctggggactgttgtggggtggggggagggggggagggatagcattaggagatatacctaatgctaaatgatgagctaatgggtgcagcacaccagcatggcacatgcatacatatgtaactaacctgcacattgtgcacatgtaccctaaaacttaaagtataataataataataataataataataataataataaagaaaagagtggacacagaaagacacacaaagaagagggttatgtgaggtcaggagcagatgttgaacttgtgctgcttgaaatcaaggaacacctggggctaccagaagctggaagaggcaaggaagaattcttccccagagccttcagagggataattgaccttgattttggacacctagcttccagatttgtgagagaataaatgtctattaagccacccagcttgtggtaatttgttacatctgtgttaggaaacaattgcagggagtatggttgttattatcctatattgccaagtgcatacgaaatttggtttagcatctattggtctcccagagacacgtcaatcttaaaggatgctaaaagctggtaggctttaggtccaaagattgactagaagtaaagatttcaggccaaatacacagcagcacaggtttggggggacgtggtggggagaaatcttgtaaagtcaacaatccattttctagttactgtctagtcacgcattataaatgacacaaacagctcacccttgaagtcttaacattatgaacctcataaattttaaaaatcagaataaagtctctgaatattcagctaacagtaaagtctttaatctaaatggatgatgaaaatggagagaatttatgttagctagaaaattaagactactgaataatttttctttcagctagtgttccatataatggtgatattttggcatatatgtaagataacacttactaaaaaagaaattatctgatgcatgtgaaaatttagagacaggtcattactaccgatcaagatgatttgctactgcccatttgagagtataaggggacagtgggctccggtgtgactatgaacatatgccctcagtaagcagggcagcttgcatccctgagaagtaaatgagtatagatgtgctctcctcaaaagctttcccttcccaccaggagtgtttgtaaatgttgaggctaggtggaaagagttggaataggatacatttttgcaaatgatataaagagggtgatatgaatacagaattgtggagctttgaagagaaagggaataatgattagcatttactgagtaccgattttgtgccaaatcttgttgagcatttttaatacactcatttatttaattccaacaagagttctgcagtatgagtagtacctattttacaggtgaggtaattgaggatcataggattaaaaaaaattacctgaatttacacagtatgtgtggatgtaaacaacgtgctttgccattctcttgtattcttggacctaaaagacctaacggtgtggttgtataagcaaaatggatagacttgaaagttttagtatgaataagagactgtggtagaaaaacattttttaaaactgtagatttaattaagtctcaaaaatgctgcatgaaaaataagtgctataggaggtaagaggtgggagaatcatttaactgttcacagaggagtgtggctgtgagctgaagatggaggattaaaagagaagcaggatatcatagtctatgtggagtctacatagaggaagaggcaggagaacttctggcttgaaacatgagcatgatggaacctgagggtcctcctaagtaggtataagagggaaagttgaaaagtttgcatgaacccagaatatgaaagtcagaatatgcagattaacttgagcctgtgaggactagaaagccactgatacgttttgagctggtaactaatgtaatgaacctgatatatttctcaggaagattaataacatagcggtatagtgagagattggtaatggggagatgggaaggaagctaatcctatattcaaacatgattatttttagaaacaaatagaaacagaggaaatagaaaataacaagaggaaggaagagatatccacaagattgcacatgactagaaaggcacaggaagaggtcaaaagtgtctgaaggataactgaaaataaagggagtcagtcaatcttttagctgctattgctgggggtctctgtaaataagttgctttccaagttcatggcctttgaagcacccttcattacaatcagtgcgtttttctgtaacacacaacgttatcataattttgttttatgaggcatagggcaaagaggcaatatgcatttttaagttcttgaaatctatgcatgtctttaagttagtagacataaataatttttaaaatccttcacgattgaattgaagtaattatgttgactacatattcaatgaaaattacttcattattctctaaagaaaatggacagagattactatttttatttggagaaagaaacacttaagtctatgggcctgaaagggttaatacaattaatgcatttttaaaagtctatattactctcagatgataactaattcacttgaagaacttagtttgatacatttagaggctccttggagttcttcaaaagaggttgctacagagttccagggtattataatcattattaattgcagtattttaaagttcacaccagatgagcttccaagaaaaatgacccaaatttatttgaaaggtcacatatatttattttacttatccaaccacatggtgataaaaatagggaaaccatgataaaatccagctcaactaggtaggtagtatggtatagcagaaacgagtccctggatttaaaatctgagagctgatttcctctttgattccttcatgtaccaattgtgtgattttaactatactgcttaatcctcatatgtcttaatttctcagctgtaaaatgggcataataatgtttgtcttacctcagtgaggacaaattttttttttcagtgctgtaattccagcagctagaactgcgtttggcacagagcagaggctcagaaatgtttgttaaattaacacgtgaatgaatggataatgaatgttgtgcgcattcagtaacatgaagcacatgaatgtacatatatttaaattttgcatccatatctattaaataccatctggatattttatctattatatctgggtaatgaaaataactatacaatgctgtgctactgcccgtttctttccaattctgcattcaatgacgtcacactggtagcttgaaattggctatgctggagcatttgtgcaacaaaatttgccaaatgctgcaaatcagacactctctctccccgccaagagcctcttgttaaacatttaccagcaaaccactgttccaggtcctcattatctggcctctgcttatactttgttgtcttctatcttctctacaacttttgctgaagtcattctgaaatactagcagtcaccaaaataatccaggctctgggcgtcactgcacaatctccaccttgccttgaaaatttccctcctagaaatacgtatcatgtcttagctaacacttactcggatatccttgaaagcagtctctgactaccccaagttagacttgggtacctcttccatgtgtttggctatcactcagtggttatcaccatgacggtattatcctaacgtatgataataattgcttgtttacttgtgtgcctcccctgagagctctttgaagtacagggactgtcttattcctaattagagtttctgtatcttgcttctacaggagctacccaataaatgatagttccatgaacaactaaaaaaccccaatctggttttgtacatgttggcaattcaggaaggctaagtgtgttattagtccaagaaatgtagtgaatagacacaaccactcttacataggcactctgtgcttgacatgatttcctgaatgttagtgggggaatccgttacactaatccacacaagtagtcgtaatgctgctggcaatttcccagacattaacaatgaagatcgttggcttaatgcaaatcattgacgcctgtgacagatcaagtcaatattaattcctgtctgatacttttcttgtgacatttgaagtcatctctgttttgtctaaaaatcttattcgtaggacagccacctacagggccacccagaatggctcattaagccaacacatttcttttgcatctttgtgcatgaagggatctagagaaaaactatattattcctgttttttccctcctgcctcacacaggtcagttgttgcaccagtcattgtctatttcccttaagatcatgtccccctgggaactacatttcccagactcatatgccaatggacttctctggatggaatacgtcaatgtgtggcaatagcagggaactaaatggcagggaaaatacggaattcagggtatttctccttctctctgctctggaaggtattttgtggcttatggctgaatcccctcttgtgttccaactttctgcttgacgcatcctcctcctgtggttgcaggtcctgccgaacaggacaggccccacctgatcctagctgcctccagacgacttcaaattctgaaatctcatgtcaccttgtgcttaaagccccagccataagtgagaacagcttcctgcgactgccaatccctgggttgttttgatcttttctcgtttggcttctcaggactctcatcacctacggaattaatttcctctattaaactccctcccttggtactatttggaggagttctctttattattattgttttttaaccattttttcttcatagtactactatcttatttggtgatgaaaatcaaaatcaaaatattctgaattatctttggcttcctattttatctgactcctcaagtctaaacagttgtcaagcccccccagtcctttcaactttcattatcttctttcatttctattctcattcctgggacaacaatgtgatggccattgccttttccctgaaatattgcaatagcctactaattggggcctttgccttcagtctctttcccttctctgtttactaggaatatggatcatagactttacttaagccagcttggatggatagaaagatagaagggattattgtaaggtttgaggtgagacgataagggagtctctggggaattcaataacagcatctgtcataactctgagcatgacaaagaatgaacatataggtggtcctggattcaaggcaacagtagaaatctcatcagtaagagttcaagcaatttcactgcacttctcttccattattgtgcctcagtcaccccctaggtgtctccctcatttgtttctgcatttacccggctgctactgtttcttcaatttcttctccctcataattctgaattgtacatagctttcaaggctacaactctgtcatgttattaaagctatacagcttctgtatctattctgaaattcttgggttttccaagaatagaaatctgattgttcagctaacttcttaatgccaagctctggtttcaatcaaccatgtagtggaggcagttacgaagggcccgaatgcacccttttactgggataggacacagggcagttcatttaggaacagagtgataatctattatccaaacaaggatatttttgagagcaaaaggaggcccaataaatgattacataggataaacaagtagaaagtgggattgttctgagtaaactgcaacttacagtcaacgtatagagtactccaggcaggcaagtattgtaaattgagtctatttccacttgttagtttctctactgctcttcatatatatactgaatatctctttctcagtgtagaatgtcattcattcttccctaacatcagcctgatcccactgctacgtcaagtgtgtgttgaaatatttttttctccatgaagccttccttgatttagctaacaggaaattaatcttttcttttctttcctttttttttttttgagatggaatcttgctgttgcccaggctggagtgcaatggccagatcttggctcactgcaacctccacctcccaggttcaaacaattctcctgcctcagcctgctaagtagctgggattacaggtgcataccaccaaacccggctaatttttgtatatttagtagagatagagtttcaccatgttggccaggatggtctcgaactcctgacctcgtgatctgcccaccttggcctcccaaagtgctgggattacaggcgtgagccaccgtgcccagccaattcatctttctttttataataaatgcaaatcgtacttcaactgtgcattctagggcttgtatttattttctattatacattataatttttatgcatgtactttgtctaataggtgtaagttcttagggagaatgagccatatttaatacatttttgtataccccacatggcctagccaatactttgcttatagttggtaggcaatgaatatttattaaacgaatgattgctgagttttctgaaaacatcattcttgccattgttgttttgagctcactcaattattctggatcctgatgtctatgaaatgcaaaaagataagatattgatcacgtctaaattagaagagtggtgagataaacagaaataagaggattggaagttaacttatttacataatctgaagaatgtttaactggaaataaaacggacagaagacattttgcttctgaagagataaacaaggaatcctagataattgaaagaaaaggaatacatttatttctcaatgagtatttgttcaatccatacatgatttatttagacaaatatctaatttgaacatccccttggtttctataatttataacatcatttacaagttcaatttaatgtatatggaaatcatagtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgatatgtatgattgtatgatacataataggtttttagcatttttaatacaactctacatatccaggaatccaagcattggaaattgaccccttgggcctcgaccaaatcaagtacgtgagacaaatatgagccttcggtacaactagagtagatttattttattccaaccattatgctccctttagctgtcacatattatgacctgggaaaagttgctaacttctctatagtacagttttctcacctgataagcaaggaggatccctaccttctacctcccagagctgatgtgattattaaaagccagttagaatcttcacatagtaagtgttcaataaacacttgccattactattactagtaacacacgaagaaccctgaaagaacataagtgaaggtcagaagacaaggtggagactattatgaaaatgtttagaaaagttctagttgggtcagagattaaagattaaaacgtttagacccacttaattaaaagacaaattttaacatattagtaataagcctcatattagtactactaagcatactcaaaataggtaagactactgaaggtaaaatcaaagcagtaccagaatatctgaggcacattctccttttgcgaagatggtagttcttaacacccttgtgatttgcctaagatcttaacatactctcaaacacattaatcctttaatcctagaacagtgtttctcaaccttagctacactctgggatcattcaagaaatattttaaaatactgatgtctgggtcctgcctccatagattctgattcaattggtctagatgtgatctgggcccggaatagctcaactgtctccccaggtgattcagatacgcaatcaaagctgagaaccaacagttcgatcgacgcttttcaaattttgacatgaataagaatcacttggagaccttgttaacccacagttttcttggccctactcccaaaaactctgatttagtaggcttggggtggggccaagactttctagttctaacaagctttcaggtgatgccgagcatgatggcctgtgagtagcgttctgaaacttgaacatttggagtgtcagaaccccctggagagctggtcacaacaaagactgccgggctacaccccctagagttttcaagtgagatctggaatggggcccatgcaggtctaagttcccaagtgatgctaacgctgctgatcccgggacctccctttgagaactactactctagataaaaagtacttactctccatctgcatttttaaaaacatcactttaataatctactggctttcaagacattttcaccactaaacaccttatcatagcagcttccacggattgctgtgcctttggattagagaaacaagtacataaggcaaaggacatatatattctccctgtctacttggatgcacagctgcccagcacccagaaaccatctgataccattcaccaagctgatggattgtgtgttgttcattctgctccttatctaatagttcttttatttaactaatgactgtaattctcattagatgctgatagaacactaagttttttttgtggaacttggcaaaactactcatggcaggacatcagttggtgagcattacctaggcagcaacacccaaccctcccgctggcctgagcagcaggtgctggtgctgttagtaatgtcgacataaggaggcaatggtttctctggccatggaagatatgttgtgatttaattcaagaattccttcagtttagaggtctattaaatgaccttctgttatgcaatctgcagtcatgaaatcttaaagaagagaaaacacctttgttttagcctaatggagaacaatcccaaggatctgggaatactattatactctatttcaccttaatgtcctcgcacttgttgttctgaaagcccctccctttccctcctgcttccgggtcacccttactcatctatcacatctattttagcacccagactaagatagtaccacccgagtgaagtctttctcaaatgtcctatctctggtcatgctgcctagttcttggagtgcatttccgtcatggtactcattacactgcatgagaactgggattatcctactcacctccccacaaagcacaagcacataggacagaggcggtatctagcacatctttttctctccagcacttcctagcagtgcctggcacagagaaggtacatacgtaacatcttccacaagaagttctttgaagcaccaatcccaccatctgctatacttgctagtgtttccaagatacttctggatccctcggtatttcttccaaatgtagtgtttatgcctttgatcatcagtgatcatttcacaagtgtgtgtgctagccctgaccataagcaccatgagaatctattgtgttcacagttttatcatcagcatttttagaatatatggcacttgcaagttctcagtaaatatctgcctgatgaaacaaataagtttctgtaaaatgggctgttaaacacagatgaaaagtttttaaaaacatcagggcttcagttaagtaaatatttgggataagaagctgtaaatactaacgtcgagtgcaacaaatatgtcaacacaagaagtcattgagtagaagtattgtcataaaatgtgttgggagctttttatgctcccataaaatgcttggggagcaatccttttgcatttagagaccatttagtatttcttttggaaacggctttgtttgaattcccattccatttacgggcttcttccaaagaatttcttctcagatatgtctggaatctcctttttaccttttgattggttattgtttgggcaaacactcattgtcaactagcaactgataagtaaagggaaaaatacaattaccagtttttcaataattttgaagcatcaatagaaacggattaaatatcacattgccttcaaaaaggggccaaggtaagggagataaaagaggcaaatgggagtttggaagctctgctcaaagtattatgaatgttttacaatgtatttcaggtcaacaaacattggcatcgtcgttgcatttttcagaaaagaatgtaagctgggaaaaaagtttagaggcaaattaagacttgagagacagttctaagtggaaataagggggatgggaaaagaaccctgtattgaaacatcattgatttccttctcacccataaacctacactctgctaaaatgtgttaactgcagcaaaatgattaactcggtgagtctagcatgtgggaagtaaatgacatatgtaacgaggaactggcctggaggtagcgccagaagtatatccaagatggcaagatgaagcaagagtacaacaacttcctggtgtagtgcctttcagaaaatctccctctgttttgttgcacatgacttctttatcttactcaactcattgtgtaataaggtagaagtagaaagaacatccttcaaaattattggaaagtgacagaatgtttgagtggatggctttgcaaactgttgaaaatgtttcatcctcaataccaaatgacatttctgctagcataatgccatgcttttttcccccttctaatactatacaatattagattttgcatggaaatcactccatgcatccatttgacaatttatcgagtacctgtttcaagtgctatgtactgagaatgcgcccacgaacatgacagataatatatctgcacataatttacagtccagtaagaattacagcttagcttcttcctgtcttactccagataaagacccttttccctcattccaccctctcaaggtgcataacttaataagtcagcatgcttaatactgttcgatctaattgtcttgagaatgtcattttcttcccatcccacctttttcaaaagtatttaatgactcctttttgcacagaggttcacattcaagctcctcaggctaacaactcatcccactgtaaatttgtattaatcatattctaattgtcctcttttgtccctcaacatgggcctgccactctggtcactccttggctgctcaatataccacccgtgttctttgcgggggagctcaagtcatttgttttttcctttcatctgaagacacatttgggtgagacttggggatttgtatgtttaagcacccagagtgactctgacataccactactctatctataaactctgcttacaacctaaggccaattcagatcctactctttctagaaaacattcattaactgttacttctcatcatgatttcttcattctttatagtacaataacacttactgtctcatttatttcggcatatatagttccagagctatgtaattacgcctgtttcatagacacaggtcttatccctccaatgagaagacatgttctataggagaagcagctattatcttggacctgtattgaacttctcaaccgcacctagcatggctctaagtatacttgcagcatacattgtgtacttattttattttaacatcatgactcttctagcaacttttgtgagttgcatttaactttttcagtctctgtagggcttacttcacaataggtctcagtgaatgaattaacccttagagtgtccgtttcatctaaaggaggattgcctgtttttgcaagttccagcatctaatgtttcaccttgaaaaatattaaccctgatgtaggtcaaatatatgtaaagctgtattaactttgtttttcaaagacatcatcatttttttcttttttctctgtgagggcttttttttttcttttataaagtaaaaataatttcaaaaatcatattgttctcttgtgatgagaaagcacatacaaaattttatttaagcaacttgaacacgcatcaaattgttccctttgacaaaaagagaaaactacttgtctgggctcactagattaccatgtactatgtcacgacgaatatatttctaaagccaaacatgaaaatttaattatcttgagctacataattgttcttctttggcttcttgccgaattttataattttttcaatagatcgaactgaatttacaagataatctttgaatttaaaacaaagtacattactttttaagccagtaagttaaaattccaattctaaaatattacagtgcactcccaaagcattgtggtttaaaatattcaaaattatataatgataatctcagtgcttttcagttttaaggtattcatgttttagtcaaatgtgattatacttttattcgtatctttcttacacatgtttcaaagctcgtaaaataattatcttatttgttctaaaacttccttacgtatgctgtactttgtcccatctcaatgaaattacatgcagcaaatttgttcctaagtcttgtgttcaacactgagactgtaattcctgacgctgtcattctactttttgaaaattttacattcaaatagaatatctcaactctttctatttgtctgtcttcagataacttattttagtttgttaaatctcagaattttcaccctattcatggggctaagttgaattaattcttaaattgtgaggatttggagaaattatagatattaaagccctagcacaaattctgaaacatagcggcttttttgcaaatgttcattttgcctatggatccacctgcaaggtgggcaaggaaagggtttgtagttctattgcataaggctttgaaattcactagtagatcacgatcagtggattgaatctgctgccttactatctacgttaaagccagttatcagtcttgctggcacatcaacaaagcctgtctttctttcaattaaaagttgcaattacaacttgctttcttttaaacctctcgtagtgattcaacctacttgtccccaaagcgtatttgattgaaaatcatgctgggccggcccaacaaatttcacacttatgagaaattcaccaacccttctcatatcatcagcttattcccccatccaaaagacattcccagtaaagtaacattaactgtttagttaattaaagaccatcttcagaatatagaaactgttatggactgaagtaggtctcctcaaccccattcatatgttgaagttttaacccctgcaagtggaggtagggcctttaaaggggtaattaaggttaaatgagttcatatgggtaggaccttaatccaataagtctaatgtcctcataaaaggaagaacagctacaagggatgcacatacacagaggaaaggtcatgaaggagaaggcggctatctgcaagccaatgggggaggactcaccagaaaccaaccctgtcatcaccttaatcttagacgttcaacttccggaactgcaagaaatacatttctgttgcttaagccacccagtgggtgtttaccttgcttaagtcatggatattttgaaatttttatatacaaacaaaagtaatgccaattaataattatatctatttaacaactagctatatattttatatatccaaagttaatcaaccgaattgacccagtaagtgtaatctttgcttatgtaaacaatacaaacccttagctcatttagattggctccaataaaatattttttaaattcagttaaagtcttaaacatggatcacttacatagcaaatatgtgtgcactacaaattgcagctaatcaatcatttctatttatgtgtgcataccctatgacctgacaatactactagcgaatactgttgagaaatttttaaacatgcactataaaacatatacaagaacacatgtgtgttgtggtttgtgatgaacaaaaacataaaaacaacccaaatgtccatacgcatgtaaaatatatacattgtgttatatacatacaatgagttgcacattgatgaacgtaaatatgtaaaacatagtattgagagaaaagaattcacagagaagattagagatggggtggttcccttaatataaagttcaaatccaggcaaactaaaactagctactctttaaagatacaaatacaggtgttgaacatacgttttttaaaaaatgagcattgtttactagaaattcaagataatggttacttttggctctggggggaaggaaggtgattagcaaggggtaacatagggagcttctcccaaaatactgatggtgttcttcttatttgaaactcagaatgttggaacacagatgttcatattattctttaaacctgtgctgtccaacacggtagccattagccacctgtggctattgaacaattcaaatgtgactaatgcaaattgcaatgtgccataaatgtaaaatatacactagatttcagagacttactaaagaaaaaggttaaatacataattagtaatttttatattgattacatatttaaataattgtgatttggatatactaggctaaataaagtatcctattacattaatttctctgtttctttttctaatatggctagtagaaaattgaaaactacgtatttgactcacattatatttccattggacaacaccactttaaacactccctgtaaacgtttatattgtgatatatttcataataaaaaataaatatgtgttaattgtataataaaatccaggttttcacccttaaggataaaaggagtagttttcctttctaaatacaatataaaccagttcaatggaacttataaaactatggacaccttctaagtaagtcattttttttaaagtagtaggtatacattacctcaatcattcaaaagcaatgagatgtggttaatttcaacacatatacagaatcacttttttaaaatctgctctaaaaatccagaaaaggggcctggattttcccaaaggcaaatctgagtggtgagttgatatattgaattatcactgagaaagaaaccaaaattcaatgaaatcttaatatagcctacgtggacaagtatacaaaatttgagcatagcaacgatacaatttaaggattttgctctaaactaattcaataattagggaagctacagaatgcctatattaaaaattatctctcctttgtggaactcaatctgaccatacaatttgcaaagcagataaattacataatttagcattgaatacttcatctgaatagtaaggtatgaatatctaatggcctctctgttttctaaaatctgctagagtcagaatgtcatgtacaagttctaaagaatttttaagagaaaaagggaattaaaggttattgagactttgaaatctatttttatcagttgacactggaagagaaacgtgggtatacacacatacatatatcttctgtctttatagtttatatagattcaatggaaaataaattcagaatctgaaaatgaattttgatcaggccacaggatgtgtgatacacagaatggggaatgcaaacagggaaacaatgtcatatattgcaaaaaaggatttgtttgggcttggaatcaaagagaactcggtataatcctctttttttttttttttttttcttctgagacggagttttgctcttgtcgcccaggctggagtgcaatggcacgatctcggctcactgcaaactccgcctcccgggttcaagtgattctcctacctcagcctcccgagtagctgagattacaggtgcgtgccaccacgcccagctaattttactatttttagtaaagacggggtctcaccatgttggccaggatggtctcaatctcttgacctcatgatccgcccgcctcggcctcctgaagcgctgagattacaggcatgagctactgcgcccggccagaacttggtataattcttccattcactttctttgcaacttcggaaaaatttctaacttatgaacatcagttttctcaattactgtataataactatgctatcactttgaaggattcctaggagcattaaatgtagggtgcctgtcctactgcaggtatctaagacctggggggtattatcatcttagtttatcatcaaataatgctagagaaggaaaccagcattagttctgctgttctaccctcttcactaacagaatttgataatctacatttgagtgagacctctaaataatagaagacatgcagctagtcacaatatcgacgtgtatgtctcactctgtcaataaaactgcacttacaaaaacagaaaagcaaaaaatattttatttataatgttaaaggaagagaatggtgctcctaaaaagaaaagggacataaatatgttaaattgacataaatatgtcaagaggaaaatagcatttctctttgaatataccaaaaagtacatataacatcacagcactattcacaatggcaaagacatgcaatcaacctaggtgcccattaatggtggacaggataaagaatgtggcgcgtatacaccatggaatactacacagccataaaaactaacaaaatcatggcctgtgcaacaacatggatgcaattggaggccactatcctaagcacgttaacgcaggaacagacaacgagtactgcatgttctcgcttaaaagtgggagctaaacattgagtgcacatggacataaagacaggaacaatagacactggggactacagaggaaggagggaggaagggaacaggcaagggttgaagaactagtggttaccatgctcgctacctgggtggtgggatcattcatatagcaaacctcatcatcatgcactatatccagggaacatgtacccgctgaatctaaaataaaagttgaaattataaaaagaaaaaaagaaaacctcatactaacattctttggaaacagttaaatgaaattattaaaagtatgatgatcatgcatgtgtacttcgcttaaaatatttatgtatgggccgggtgtagtggctcatgcatgtaatcccagcactgtgggaggccaaggcgggcggactgccagagctgaggaactcgagaccagcctggtcaacatggtgaagccctgtctctactgaaaacacaaaaattagccaggcatggtggtgggcacctattatcccaggtacttcggaggctgaggcaggggaatcactcgaacctggtgggggcagaggttacagtcagctgagattgcgccacctcactccagcctgggcgaaagagcgaaactccctctcaaaaaaaaaaaaaaaaaaaaaagtatgaaacaaacaaagaatatattattttactattttagaagagaaaagctctaggataggcagcataacatatggtcagaagcagggacactagagccactgtcttggcagtatgaccttgggcaagtaacttaacctagttatatcatttgctagctaaataagtataataataaaacctgtcctgtgggattgttgtgatgattgcctgaattaatgtagagaaagtaatttgactaacgtctggctcagaagaagcattactacaacacttaggcatcatcatgattattatcatcatcgccatcatcattattactattgctgaaatgaatatgaacagaaattaagtctctgaaaagcaggaagccccactttatgagggatcatgtgtccaagaagaacagttgctttcaaatatctttttggttgcaaagtttttttcttcttcaataaatgcaacaggggatcccaatactacaattaaatcagagtgcatttagttgaacctggttggtagcctcaagtcctcatgtgtgtgtttctttccactatacttggtgttctctgaagcaagtcaatatcaagtagaacagaggcatttaatgttaaaataaaactagaataaggcaacaaagaacatgtataaggatgcatgaagattgtctctgggttgagagtactattaaaacagaaatcttgcatttgacttcgtatcacttaaaagcacttagaactattttaatttaaaaatcctactattaaaaataggtttagtatttaaagaggtaaattctaattttctataactgcagtatctgatgacaaccactagccgcatgcggcttttgaaatttaaacgttatttaatattaaataaaaatttagttccttagtgtccctggccatattaccattgctcagtagtcatgtgtatctagtggctgttgtattggacagcacagagacagaacatttttatcatcacacaaagttatattggacattgctgatttaggacattttgttacatggaaaattatgctgacaatattaggtgtgcagaatattaccataagcaatagcaaaatactacatgggtttgggaacacttttcctttctttatgcactgcagttaatgaaacaacttaaatgtaattctctggaggaatttattttcttaagtacttctcttaaagtgtctgcaatatgatttttacctgagaagtgtggcacagtaggaataaaaacacggtcagagttagcaccttcatgaccttgagaagtcaagaagtctccctaagacccaggggctccaggtaacagggataatgacagttgtccaccaaaccagtttacatgaagaacaagtgagaaagtgaatagaaaaacccttcgtaaactctgaaatcctaaacaaatgttacttattatgatcatttctacatgtatttttttcatctggatgaatgtgaatgaagtgtataatttctgtagaagtagtcgagctagtctaaagcaaaatgtcacagttaaagcatttgagataaggcacatttgtggtccaaagactccagggctactgattagagaaaaatgcatgtctggttaaatacatttatatgataattactagataatctggactttataattcagatataaaatattttgttaaatttgataaaatgttgcctcatctccatttcatcaactgagacatttattttgactttagctttagagataataagctaagagctgccacttagaagcatattaaaacttcacgaagttttacaacatgctaatttaatgctttattagcttatttcatttaagattacaaagaactaaaatgatcttggtgaagtgttgatccaatctcattccacaatgggacttaatttctgcctagaaggcaaacttagacatttaaatttggaaattaaaagaaagaaactgttatatatcagtgttactaaaccctgaagacaaaaacatatatagagaattgaaaattaatgtagttcagctgcctgagatttaatatgctgccaaaacaaaatattattcataaaacacttttcaattgtagagactaaattattttcctcctaaatatgtttctttctcccctttcaacgattaaaaaatgtatctattcctctttgtagcacatagctgtatgtatacgtaagaggttaatgccagtagctataacaaagagatcccacaattttagtggcttaagaaaagaaagaatactacaaaatgggcattcccatctgcaaacagcttttctctacccagtaattcagggactctgagtccttccattttaggctttttcatctcctaggtctttgggactcttttccataaggttagcaaatgggaagtaagaagatggaaaaggtatgcctgcaacataactcccactcacattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctccccttctgttaactcatttttctcccttaaacatgtagaagacaaagtaagtcctggcagagaaaaaaagcttggtgtaaagaagaaaggaattcttgaagttggggacactagagattatcagttgtttttatttttccctgcatcaaacctggattctttcctaataccccttggtttgtagttctcattatcagcatgaaatgaaagaggatgtaattcagggttatagccccaccataggaaccctgaactacagtcttaagaaagtttaagactgaaccctttagcctgttaccttacacaaagcactgtggagtcccttgaacttgagagatccctcagattaccgtggcagcctcttatttcacaaaagttatgtcatttgaaatacagaatcaatacatccatcttctcttgaggaataatgcgagtgctgtcaaatgcctactaaaggactgatgtagctatcctgactgcaaaatgtccttcttgacacaacaaagagcacatcagaccattcagtatttatacaacttgttctttcatctaccacagatttactgagcacctgctatgcgttaagccctaggccggaagttatggatacaaagacaaacatgagtgggtctttaagcaagggagttataaggtcatatttgcattaataaaagtcactatgaagagtagagaataaattgaaggagcaagaagagaggcaggagagggagggagagccagtggtgaagagactgctgaatcaatgcaggtagaaggtgcaggctacccaggtaaagaaatgactgttcaaatgaaaacaagtggataaattcaagagagtttattgtagatttggtaggacctgataaatgaacgtgccttactcgagtatggtggtgccattgtctgaaacaaagaagcaaaagaagaaccccgctcgatggtaggggaaagcttgtgagctgagtttttgatcttatagaaattaaaaggttggtcaagtgtatgaatggaagcagttgcatatacaagtctggaagaaagaagatgccaggatggagggaaaatgtagttggaatcacggaatggatgaggatgaccaaaggaaagtctgtaatatgaaaagtccaggaaaaatccaactttttgaggaatattaaagggagagatgccagaaaatgggctcaaaaaggagggattactaagacttaggcagtacatgttcattcaacaaggagattctggtactacagaagctaaattcccttaagaaggaaggcattttcacccacagcattttgctacagaatgctcgagtataatcagcactaaaaaacatttgtcaggtttggcaacaagaaagttgctgccgtccttcttgaagtgaactgaaggaaaggaggaaattgaaatttattgaacacaaaggaagtgtctgaggaagtgtcttattaatgagatcccaatgcggcatcataagcaagtgatggaagtctctgcatataccattttttttttgtgcagtgttataatgctatattatcaaacaaaacactttctttttcttcatcctcacatacacattttcattttagaaagtcaacgtgcttttacttagtactagtaaatatgtcttgccaaaaagctaaaattgtgtaaatcatcaaaagtctataataatattaatgctctgttttgaacatactgaagcccaggaattgccttatttcccccaacaaccctgcagcttttctgaagagaaacctgaggttcacggatagtaaattatatgccagagatcaagcaggtgggaagatgatagagatgaattttatcccagctctgctggttctttcctcctcatttaacgttccaccaccttattcctttaagctccaagtaccaatctagagatttttataattaattcctaatgtctgatgaaacctgaccgacctcatgcaaaaatattaaagaatacttattgaataaatcaatccaagatacaattgaaaatgtaatttaattaggtagaggtcaaacttcacaaaacagaatataacataaataatcaacaccataggcaataagatagacatcttattgcctcaatttctgcaggggataaattgggaaataaggaacacctaagaatcagaaatgaggtagaaatattgaaataaaaacttgatctagaagatcacagtaagttcttaaaacgcggtcctcctaggacccagcacaacacgtaataaatgctgcctggtttgaattgaacttaaggtagcattaacaagaacttgggaagtgctgacacaaaatggattctcttattctagacaattcttgtactgaatgaacttaatttctttcagttctggcatagtttggatgaatcttcctcataaccatctggttgtcttccttcaattctgtgctgctaaacaaacttctgtttttaatttgttttgctaagtaaacttagtcatgaggaaaatgttagtctatgtggatggtcgtgtaatattctccggtaacctttcccccattacaaataatcacattgacattgtgctcattatccactagtttgaacctatggggttcaatgaagaaatgcatttctatgtctacatgcttagcaaccagatcctggtctcagagataaaatgccaggaagaaatcactcgacgataaatccacgtctcagaatttgctctaagcctgagaggagatgacggagttatgaagtgctagatgttgaaactcttatgtgcagacttcttgagaatggagttaaaaaataaaaacagagaaaatcaaagtcaaagatataaaatgttgagaaatcaaacacctgacattagctatgagaaatgtttatggcaaacactgatcctcgctttctcccaacaagctgttatctaattgttatttgttgtgtgatctatatccaccatttcaatcaaagcatgagcaagacttatttcaatagccatagcattgctcccagacaaacttattcattcctcctccattcattatatttagctctgttacagcatcaactgtggaatcctgaaataattctcttacatgtctgcctccttcaccagattgtggagtctgtgaaggaaattatgtactctacaaatatttattgaacacctaatatggaccagagactgttttagatgataaggagatagcagtgatcaaacagtcaaaaatttctgtccatgtgaatcttacacttcaagtaatgggggatgatgtaaatttggcattgaagaggtttggcttgtaacttggaatcattattttctagctctatgaccttggtaaagtcacttgaccaaaacttgagctgtcttatttataaattgaggatcataataccttatagcatggctataagattttaatgaaatgatatcatatggcctaataaaaaagtagctaagctttactgtatacctgttttatagtagcactgttgtgctttaaatcttacaacaagtcttcaagataggtatgattataggaaggttaaattacttagatagtcacaagttagctagtggaagagctagaatttaaacaggcagtttaattgcaacatctgccctgttattcactgggctctactctgtatactgctttctttagtatcacaaagtgcctgccgtatagagggcagttgtgacagtgaggatgctattagttgctcataacataaagctgcactcaaattaatcaaaaacagtaaacaaagggattctactggttcacgtcattgaaaactgcagaagggggctgcaagtgaagttcaatcagggggtcctgctccatatctctcagtactcttaggtctccctcttgtgtctgtcagccttatttcaggttatcttctgtcatggtattacaaaggctgcagctctaactatcacatatgtatattacttagttcaacgcaagagaaaaagaatttcccagaaacctttgcagtaggtctccttgatttttattagtccacagtaggtcatgaggtcatctttgaacctgttactgtagattgcactggttcatctgggcctgaggtatatgctttattcctagagcaataccatttgcgctccagaggagagttcttaccaccgcaaaaatccacatattcaccaagggaatctctctcacacagtcaatatagtttagttgaattaattaatgtctcaaaaataaattaagcagttctcacatatttgtagacagtattttctaactactaaatgaaataacgaaagtaaaaagaaggcaaaagaagaaatactctttaagcaatctcatgtagtaatattcattcacgtaatcattcctggcatatttctgtttgaaattcagtcatctacatggaaacagcggaaggggagctcaggacaatatgccattaatatttcatacacaatctgtttaacactaaacaattcatttttataggagttttactcatctcccacaaattcaaatgtttgtcttgctaatttttcatatttaaaatttgcttttcagctagcattcattcactaaaaggtctttgtacacctaatacttcgagttcaagctcatgcagaactattttattattttctagtaggaagaacagataaacatttcgttgcaaatgtggtagagttctgtttttaacgccaatattatctgtgttcaatgcattatctcttatgagctacatatttttgggggggattatattttttagatgtacctatttagtgttccaattaggttaatgctgaccgaaagattttatacaactaaaataaaattaaattgattgaagatatattttattgtttatttgaaacaatacttcataagtgatatgattttagatttatactgtctccatttcacattttcatttttagagtactttattgttatttagtcactgaatcttttccacatccctcgtaagttcaatctggaatgtatatgctagtgatttgttaaacatgtaaaattaaagtattgatttttaaatataatgtgtatatatttatttatagtgatatataacagttgtatgtatatgggggctacatgtgatattttgatactttttagattgctcaatgatcaaatcagggtaattgagatgctgattttttattttgtaagaagtaacagaaatgggaaaagaagcacatggaaagcgcttagatgtaaactacttgagtgtcactgcctctgggttagcccaatttaggccatctacacataaaagctcgatgtggttatttcagaaaaaaaatttagaccttaacaagtagggtccttgcccttgggccccatgctttcaaaggcaaagctctgattaggagtctgtaggaccaagccaacatgctcactagaagccccgctcccatgatctggcattcagaatccctcaactccctgggcaaatgtttcaaagtcagttactgggtatggctaaggggtaaatctttgcatgaggtgagtgggaaaaacttgaacatgtgggtgggaaatggggcgaccagatctatgtgcacagagttcctcacagtgcaggatggagtaaaggaggtagggaaaaaaggcaacagattcacaatagctaagatgcagaaacaacctaaatgcccattggcagatgaatagataaatgtggtatatatacacaatggaatactattcagcctttataaaaggaaattctgcaatatgaaacaatatggatggaccttaagattacgctaagtgaaacaagacagacacagacaaatactgcatgattccacttacttgaaataaggtatctaaaacagtcaaactcataaaatcaaagactggactggtggttgccaggggctggggatagggcgaaataggaagttactaatcaacagacattacatttcagttaagtaggatgaattagctctagagatctgctgtccaacattctacctagagtcaataataatgtattgtgcatgtagtatttattaagatgatagatctcatgttaaatgtcattaacacagtaaaattttttttaagcttaagaaaagccaatgtatcctaaataacaggcttagggttagctctaaccaagctgcctcattccagtacaaaactctaaggaatttattttattgtatcaagtggtttgctatttgagttttttccaaattccttgccagggaataaactgcttgcactatttaaaaaaacaagacagacagacagacagaaagaaagaaagaaagaaagaaagaaagaaagaaagaaagaaagaaagaagaaagaaagaaagaaaggaaggaaagaaagaaagagaaagaaagaaagaagaaaaagaaaatgagagagagagaattctaaatcgaatctagatgtccatatcattatgattgtataattgtcaaggaaagcagataggatatatttaatagtctgttgactttataccttataaatattaaatatgtggcatgcaggcaaccatttgcacacttactataggccctgcaaaagttatggggcagttctaacctcatatgactatgcagaagactatgtgatacagattatcaaaagatgacaattttttaaattcccagaccaggatggtatgaggagtgagaagcttttttagacaccaatgcatagctcttacagctgggatgctctccgaaggcattattattcctttttcttaagggaatgaagccagacataacacaagttataagttacgagttagaagccatgacttgaacacattcaaaagcatttccctggcatacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaagatttaaaatggaaatgtaatgcattgaaatcaactcaaacataaatttcacacatattttgcttttttaacaaaagccagcgttactgcccaaaatgtaaatgttctggtaaaggaagatatgtacgctattttcaccaattaattttcataaaaagaagcctagtaaatagaacataaaataaatatttaacatccttaaatactaaaaaattaattatcttcctaaggaactgtgacaaaaagaaaaatgtgatttcttgctttgtaggtcaaaatactttatttgctacttaaattttcaattccattcaacaactatttactgacttgttcttatatgccagaccctgtgttagaactgtgtacacaaattaatgtgatattgtccatgttcatatccatagtccaacccatcttagggagtttaagaagcacttcatcttaagactaaagctattattttaggtgtgtttataatatctaaatcaaaattctgaaatacaattattttgcaaaagacgacaaaagcatcattttactcaactgatcctgaagttttaaggcatatttgatttaaaaaatttaaaaaagaaagaattggggttgggaaaggggagtataaactgatgatataaaaatcactcaatttagactctagtaaggacacaagaattaccaaaacagttacttctcatttaatcattttggtttgtttaaactctttagttatttgggaaagaaatgtattgagtacctgctgtgtgttagatatggtgctaggtcctatatgtggatgtgtgatatgactgatccagttcttatcctaccgtaacttacattctagtaggcaattgcatgagagttccttaagagctataatagcagaaatacaggcttctaaaaaacagaaagaaatacaccttctcctctactagagtgttagaaaaacacatatagtaatattaaatatatacagatacctaatcagacttattggtttggacagtgggataataaggctagtaatgatttcctggtagaaaaaaaatatgtaagtcttcaagagtatggataagctcagataaagtaggaatgggagagataggcaggggtggtgatgtttagagccactgtgaatgaattcatgtcccaacgaaaaaaacaacagggaacgttaggatcgctgattccgggaattgtacagacctttttccttgcgtaagctaagtagtttttagagttacaaggaaaagagatgtaagagactggaggaagaaacatttaagaatctgaaaggacttaagtccatctgggaaggaaaagggaaagggaggaatggcaaaggttagggcgaagtgtgttagggggagtagacaagtgagagagtcctttgtggttaaagaactagctaataaactaggtctgaaagttgttactctatccctggaagaacaaataagaattactgaaggcttttaggcagaaaatgaacacattcagatttttgttttttaaaaaattactctagcttttgtgtagaaatagattggagaggagcaagactgaaattccagagtctagggtgtagaaatagattggagaggagcaagactgaaattccagagtctaggcaagagatagtgttttgaaatctaagcaggagatcagggtcatctgacttttggttttgggtgtaaagatggggaaaataagacattctagagagaaaatgtaagaacgtatttaacaacaaaacttagtgattaattggaggtatagatggtgtccaggcttctgctttattcaactaagtggatggtggtcatattaaataaatcagggagccagggaggagaagcagaatttatagatgaggtgatgagctcaggtgagtattttaagcttgaagcacctgagggacatctaaatagagatctattagacatttgtgtattcttgtagcttcctcagaaaaatgatttgggctggaattatagcttaagggtcatcaacataagaatggtaattgcgttcaaagacaagattacccacataatgtcaagtaagaggaaaagaggtcctagatcaaaactatgaaggatgtcgtcaatacttaatggaagggcagatgaggaattcacaaaggagttaagagtgtagagtcatataagcaaggaacagagtgttttaagcagaacagagttgacagtggtccataataaggtgaactaggataaagactgtagaggacccaccaaatttagcaacatgaggaccatcagtgtccttgatgagagtacctcccatgagcctttgctgctagaagtcaatgtgcagtgtgttaaagcagggctggcaacatgatgtggagacaacaaatatagataggttgtttatgatagagggttatctgtaaaggaaagtcaagagggaaataaccagtgtagcacatagacttcaagggttgttttaatgattaaacaaaaatactagagaatgttcaaatgctcatagaatatgggatcaatctctttctcaaaatactgataggatgatgtgaaaaatcatgtcttcatgagcaagcaatgtggaggcagtatattcccacagaacatattcatggaagtgttaacacaaaatattttaccaagtaatgaccatctctaaaatcacatttgtaaaaactagcgtgctttattaaatcttcatgggcaagattaactgatagacacagagcatttatttgttcaaatgttgagaattacaaattgaggaataattatttctaatgatagattcttaaaactcttattattaaagatataatacactaaaacaataattttcagttatagcctccttccattgattcaaacgaaagacacacaaagtgtaaccgtgcataaatactgtcaagctttgaggaatatcgatttctggaaatcctccgttttattggtaccgagattttccacagaaactcactaagcaccactttttgtaactatcccatgatactcattatacgtgccatgcacacggtcaatttctagtaaattagaaagtaactagcataatcctattatttatttaatttcaatgatgttatcattgaatctccagtattctagaaattctttgtttccagtgtatattcatatatggaataaaccactatttattttaaattatagcaattttagaaataacctcattattccaatttttcatgttctgcagacatctcacaactgaacttcccaggctacaactttaatgtggcaaacacataaccaaaccaaagtagaactgaccggactgtggcagagcacatggtcatttgttcaatcacttggtcattcaacaaacgtcttctaatcagctagaatatgtgccaaggtctggccttaacataagagatacaaagaggaataaactgtaaatagtcattgctctctagggcaaatctagggaggaattcagacaaaaataaatcctcatataataatagtagaaaactcaaaagggacattaagacggatctatcgactgccttaagccatgatgttggactagggagattatacactaggttcgtctgggaaaggtctggtgtacagctttgtcccgtgacctttcctacactttttattctcaaaataaatacattagcaatgatcttgtaaggtgaaacaaaagtccatcaggaaaacaggagttggcgggtgggaaatggtaccttatgaagagaacaaaggaaacaatagcatgggatatcagagaaactctagcaacacagtatagctggggtgaagagtatctctgggcgaggtcatcagggacaaagtcaattagagggatagacagagttccaagtgtcagggaccttgttggtcagactaagcaatctgaactatttggaaagcaaacaaggtaaccctggaggattcctgaatttcaatctagaatcacacactatacttttttttttttcaattttgcatgacgacttcagggaaacatgccaatgaaaaaatcaagttaaatcattacattaataaatttacttagtctaggatttggaatatttattgcaagtcaaactaacctgttagtcattgcatataaacaggttggctaaaatcaaattttaaaatgtagatatcaataggtagtctctgctctcaaagggcttacaatttccctgtaatcgtgtcacttggatcagcttacacagattataatcagaagcagagacagcagagataactcctgaatagagaaactaggttaagaataatgggcatagatatgtctgtgtgtgtatgtgtgtgttttagataagttactgatcttctctgagcctaagttttctcagatgaaaatgagaaccatgaagccttccttacagggtgaataatggcaatccaatgtaaaggagggggggatatttattccaggaaaaacgaacaagagaagtagaaacaacacatacagtgcttgcaaagtgtataataggccttcaagaaatgagaattattatgctatgtcacagtctgatctcattagatactctcaatggcctcatgagaaggatgagaaaggaatacatttctcccattttacaggcgagggcacaaagagaacaaaaaatcaattatttgcttcaaattatacagctatttattggaaacacttgggctcaaaaatatcccgtttccaagtctttaccctttctaaaatgcacactgtccgtgaaacatgccaaattgattttatcatcactaagatgaacttatccatagatccttgtgcccccaaatctcactgtctcagttcttgggtgcctcaagtccaagttcccagggcatctgtctatgagtaggatattcacagtgagtaaaaaggtaatgccataaaaatctaggtgtgggttagtagaatccaaataaacgatatagaacatcacaactcatattcaaatatgttaactaaagtaatgatttcctattacttagagtgagggtctcaaaatgttcctgaaatagatctcaaaatgtattccctctgtctagttgaaactttgtaatctttgaacagtaactctctattccctcactccacctcccaagcctctgttaaccatgattctactctacatctctatgaattcaacttttcttacattgcacatttaagtgacatcatgtggtatttgtctttctgtgcctgggggaaaaatgttcatgtacctcagaagtaaacacattttaagcatgtaccctatataaatatatattcacagacatatgtaattttaaattacattgacactagttttgtagacacaacttacacatcacatacactataaaatatacaatcaaaatattaatttctagagaacaagataaataaaaagtattttttctcactaccccaactgtttagcacgcatattattgggcatgtacattccactttggtaacaactgacctagataatcaaattcaaggtcgttggagtgacaaaatccttcataacttcactggtgtgtgtgtgtaagcgtgtgtgtgtatatgtgtgtgtgcttacaatccccactagattttaaactcaaaagagaaccaacaatgccttcatattttttcttctctctcttcaatctgtgttccctgagatccttttctatttggttcactggccctttaaccccaaagcagtttccactctgtggaagaaggaaatagtttcattatattttggctctgggttgtttcttcatttaaaaccgtagctaaagtccagaccagagaatgatttgaaaaccataccttaagaatgagtttttcctagtacagtagacataagaactctctggatgggggggagtcaaaaagaaagttggggaggaagcaagaaaattagatgcttgtaggtttccgaagagggggcctgatgtggcagtatttcatcagcaagaagggcaaaggcagattcactaaatttcttgaggcctcagagtgcagccagcaagtggctacatttttcctgtccctgaaaagagtgtgggagttgactgaggaaaagagttggtcatagcaagagatgcttaactgaaaagctgcatgggccatgcagtgttaaactcaagaaattgaggccttgagaaggggacccatgggcagatgctcaagagtaaagacattcagaaccaaggtgcagacaaaaccgtgcatccataagataacaatgtatacagacacatcccctgaaggccatacgtgcttcatgaacacttgggaactgggatgcctacacagaaagaagatggggaggaacaatcctaaatggaaaccaatgaagaaaacctgaaatcaatatggttatgttttctgtcttcaagtagaaaggggtcatgtccatccattcaaaagaatggctaagatgagattaatcttgcatttcccggatgcattttccccaagttggagtgtaagccagctctttggagctttagaactaagcatcatctcttcttccttgctgacatatgttctattgaacatcttttctcaaaatagacctgtttcgcccacattgaaaatctgtcaaggcaggtctctccccccttcctggtgatctccacaagtgttggaagggatgtcctggcagtcgtggacctgcccacttactgccaggtggtgccgattcaactgggcgcagagcccatatggcatctgtggcttgagacataagtatcatcagccacagtattccccaaattcttaaaaaccttctgctttctgagttaacattgggcttattgtcatctagtactgttgcttttattctagctgtatactcatatgtttgagtgttttgtttactgatacttcctcagtttttgtttctttcctgtacatcactgtaacagcagcacattctccacacattgaaagactcattgtctgtccttgagcatcatctctactgtcaaatgatagccctcgtacatgcatccactacattcatcattgtctcactatttatgttttgtaactctcattattattataggtcttcagtttctaacactttcaaattagcactgtcgttgaattaggcataattagatttaaaattttgctaaagtactccacaactaaggaagaacagggctccaagtggttaacattaactttggtgggggtatgataggagagtgttgacgaacctgtacttggagctagttttatttctatttaggctattactctctctttctccatgcttccctccctctctcccttcctccctctctctctctctctctgttcatatatatatatatatatatatatatatatatatatatatgtacacatatatacacacacacatatgtatacatatatacatacatatacacacatatgtatacatatatacatacatatatacatacatatacacacatatgtatacatatatacatacatatacacacacacacacatacacatacacacacatatatgtgcaataaagaactgcctgagactgggtaatttataaaggaaagggatttaattgactcatagttcagcatggctggggagacctcaggaaacttacaatcatagtagaaggtgaagggcatagtagaaagggcatagtagaaagcaaggcacctcctttacaaggtggcaagaaggagaatgagtgaggagggaagggggaagagccctttataaaaccatctgatctcatgattcactatcaggagaacagcatgggcaaaaccaccctcaagatccaattgcctccacctggtctctcccttgacacacggggattataattcaaaatgagatttgagtggggacagaaagcctaaccatatcaatgtgtgtgtataatttatttctggtagatgaacatgttcatcaaaatcaactatataatcacaatattaactgaaatatctgacttttaagaactttaaatattttagaggttgcctacggctgtacaagtaaataaattgatagagcacattcttttaaatataaaatgagaggaaatagtcttaattagattactacattttccccatggatgtgtcatagtacattctagaggaaaaaagtaattgattatatgaagattagaataggtatatttaacaagcaggtagtgtttgtggaaatgttctaagatgttagaaaaataagaataagatctactgtttcatagcacaatagggttgctatagtcagtaataacttaatggtacattttaaaataactaacagagtataattagaatgtttgtaatacaaagcacaaatgcttgaagggatagataacccattctccatgatgtgactatttcatattgaatgcttgtgttaaaacctctcttgtaccccatcaatatatacaccttcctcatgtaccccgttgacatatacacctaccatgtactcacaaagataaaaaacccattgaaagaaaaaacttaaaagaaaaatggaaatgctctaagagatgacgacaggtaatatacgtcttagtgcatttatgtatgtgtttatttttgcaagagatagacataactgtcagcccctggacacagctcagtggatagtgacttttgctaacacttaatggattccatatgttcaataaaaaatcattatgagaaagttcactgaaccttttatacaaactaaccatgcaaagctcaattcaaaaaggcacctaggaagtgaatgcaatacttgcatatttcctttgacatgaataaatacaaaggcattttattttaattgagttaaagcataatagtttctcttgcataaataattaaaatagaaagaaaaatagcatataaggagacttactgatatcaggcactgtcctaagtatattatatacactgaaatatctatcaaaacaagcctatgagagacgattattagatcaatttgagagaaaaattaactgaggcttacgtaggttaactcccataggttatactaatagtgatgcaataaaccaggagtttcacctaggcagtatgcccaaagcccatgtattttaatcattataatcagactcctacattacataccactgattttaatttggaaagataatttttttctagaaatgtttctcaatagtattttgttctaatacaaatgtgaacacctttaaaatcctaaaagtgttaaacaagttggggggtaataatctgacattctcccaggtaaggggatttcgaataaggtcttcctatggcatggcaacattaaagtcctcactaagcaacatgttatttaacttcatgacactgggaagagagtatttgccagctttagaaagcaaatgttaagaatctaaacattatcaaggggactattttgcttaattttgagctttcaacactaaagaagtatataaaggaacatgggtatacttcaatgattatgtaagggtccaggctaatcaaatcatcactgaggtggctattacacacaccaaacatataatcagaaaattgtggctcatgagaagtttaacttaagcccttcctattcaataggggatgtcttaggaccaggatgtttgatgatatccctgaaatcacaatgcctattaatgttaacagcctattaaaaaaaaaacctacacatatccttttatcgttattatttatttatttatttatttaattttttttttgagatgaagtctcgctctgtcgcccaggttggagtgcagtggcacgatctcggctcactgcaagctctgcatcccaggttcacgccattctcctgcctcagcctcccaagtagctgagactacaggtgcctgccaccatgcccagctaatttttttgtatttttagtagagacggggtttcactgtgttagccaggatggtctcgatctcctgacatcatgatccgcccgccttggcctcccaaagtgctgggattacaggcgtgagcctccgcacccagcctatatcattgttattactatcgttattactactattattccaatgttaatatggtgcccactgttttaaagtagaaatgctattatttaatcttcttgtgttcgtattcaataaagaaaaatataagtattatgacaaggcagtgatttggacaggatgtttcgaatgcaggcatgttgacatataactggacatgagccctgatatagtttggatatttgccgccactcaaatctcaagtggaaatataattcccaatgttggtggtggggcctggcgggaggtttttgggtcatggggacagatccctcatggttttgtattgtcctcagtgtagtgagtgagttttcatgagatctggtttttttttaaagtgtgtgggcatcaccttctgccatgagcaaaaactccctgaggcctccccaggagccaagcaaatgcctgtgccacacttcctgtacagcctgcagaaccatcagccaattaaactttttttcttgttgaaatataatgccaagtgttggacttggggcctggtgtgagatgtttgagtcacggaggtggatccctcacagcttgatgctgtcctcatgatagcagctgagttcttgagcgatctgttttgttttttttttttttaaatgtgtggcaacctccccctggcttctgctctggccatgtgacatgcttactcctgtttcatcttccactatgagtaaaagctcccggaggcctccccagaagctgagtagatgctggtgtcctgcttcctgtacaacctgcagaatcatgaatcgattaaagctctttttaaaaatacattacccagtctcggctatttcttcatagcaatacatgctaacacagacccaccctccccgtctgtccttgatactcttgtttttctgccgattttattcctattgtatctactctttgtttgatgttaagaaaatgatctttgcttcaaaaattcaaattataatcctgcaagctctttgatataagtgttcaatttaaattaaaaaggcaaaaccaaaataagactaagcataagaaaataatacactttcccttagttaccagagtgatatatttgaacattttaaatgctttcaaaaaatcaaatttctaaactgttacctctacttaatcccacagaggtgataaaattattggcaattgatgatcatgtggataaattgactgacaatttcattcatttattcattaatagctcctcattgatgtatgtatcccaaatgtctcctttccttctctcaaaggggcaagcaaaggaaatggaaactgtaacagtaaaagccatatactctaaggtggacattagaaagtctcttggtctacaggtcgtttttaatcctaaagacagaataatctacctatatagaaatcattaaacaaatagaaattttgccttataaatagtaggaaaatacatacctacatttatggcctgaaaaccagcatcagctatgttatagttgtccacatagaactaatataatgtactgggtagaaagtgaccatttttctccattttgacccttgtcatcactggaagaacatggattccattaaggttcccacattcattacccttctcctcacacagaaatgcaaacattgaaaagtttcttcgtggagagttctattttgttttgttctttttgcattaaaagttcaatactatttattcaagtttatcaagctgaatgaacaaatggcctattataattgcatttcatattttgggcccttaaatttcgaaatctacgtttccaaagagaaagttaaaaacaggggaaaatgctgctaaattatttgatgagcttcatatttgtgatgctctcattttagttacattaaggcaaaaagccaaaataaaatcccaaggcttggagtttgaaacaagtggtgaaagggaagggagcattgataagagaggcaggaaagatagatttaatggcattttttttgttttaaataatgcttaagaagaaaaattatgtttattacactcagtttatttccctgtggaagaacaaccttttcctctcctcagtctggaactcatactctttgccacatgacctgtgggaaattgacttgaacagatgttttggtttcacattaaatctacaaattattttgcgtaattccctagtgcccatctactataatttttatgatgtctctactctttgttttttacatactatgacaaaagagtcataagacatagtgcctagtcagtaattggctcactgaaatgcttagagtttatatatttgtaagaccacacaaaatttcaagcaggaacctttcagttatcacaatctttattaatactctcttgaaattgacactttttaggcttcatatgccaaaaaacatgagagtaataattgaccttatgctttaggacatgtttcttcttaaatacttcttattttaatattagtaacaattctactactaataatatctatggttcattgaatgctagtctacataggtgcatagatacctggatatagatgataaatagatgacagagaaagagaaagatagaaacagagaaatatttttactttgaatgaaatacattatctctcccatcctaataaccaccttccaagataagttcacatcttattattagagatgagaagatttagttttaacaatagtgtttgactgaacttgaaatacacaggtgtgtaaatattaaaacattaaaacattcctaaaatctttgcagataattagaaagagtctagcaaacattatctgtaataaaaacatatatatttaatttggaatgtgctttaattttgtggtattttgtgaccactctgttccttgtcccttgcctgtgattagtgaatatagagtgttcatttattgacacttttatccactatctctggaggacaaatgtgaagtagttgccaagactctactttaggcagtttcacatatcattaaaacaaaaatttacagattatgtatttccatgaaatatgacaataacaaattggaaggctgagggctaattttacacataattttgcaaatctgtttgttaagaatgagtatgcaattcatacattgacattctggtagttcatcagtttataaaactagtgaaatggaagaatgcattgaaatttaattgttggtatcttcacacttttgctgactatattaaaacagatacattgaactgagtggtcccgcctcctaataatttataacatcttcagtttctgccactaatatttatcattatcttatgaacaggtctgtgcattgaaataataataaaaacgataaggaaataaatagacataactattatttattcagtgtattattaagtgtatgatataatgccaggcatcctagatatatcatctcatttactcctcacaatgaacctattaagtagatgtccttgtgcctattttaaaaatgaggaagataaaacgtacagaaatttaacattttgcccaagattgcaaagcaaactaaatgcatgaacaaggatttgaactgtgtttttttttttcatctggaggcctccgttcccaagcatgcttttaaattttttttttctcttgacacatatcataaggtttcttctcatttttcacatcatatcaaccagtctctttgctgttcctggaacagcatattcacatctctgggcctcggctcttactagttccttatcctgactcatttctttagatagtagcatgtttcattccttgacttgatttaggtctctgctcagatgtcacactctcagcctcctctcttcaccactcttgctaaaatactgcttccctttttcctttaccctgatgatttttttcatcgtacttttaatctgatattttatcatatttattgggttctttgcctcccctgctaaaatgtaaattccacaacaaagggacgttgttttctttatggatggatacctggtacctgcaacaaaacctggcacaggctgattgactagtattggttgaataagagcaaaaatgaatgactactgagatttaccctaaaattttcaaatattttgatgtataaaaatagtctatgaatgtaaccaaactgtgtggacagaggctgatggggtctcaagtggtgtgtgtatgtgaagggtaagacattttagaagaagtacctatgctggattttgaaactctgaaaggacaaacgaatggagggaagaaacagtagactgcgggatacttgagaacgagaagaaacaaacaaacaaacaaaatgaatgaaagccactgtcagttcttggaacacagagttgggaaaatgtattatctatatctggagaaatactcaagtcaggggaaggagaacagatgactggcaatgaagggacctcaaagcaaggtctaattgagatttgagacaacagcatgcatccacttggagttcttacaaagaggaatactatgttcaactgactcgtacatttgtaatacgtccgttaaaaaaaccctattgctattggaaatgagtatggaaagctttcagaatggaagttttattccattgttggtaaggggtgcaataaattattcatgcataaccgcaactacaaggaaatgggcataaagaggtgaggtaagtaggaataagtgctagtgcatatataattactaaatggaaatggtttgacaagtctgatacaaaaaggctctctggaccccaatttcaaataaaagacctgaagtgatacatttattccttatcccttcagagtctccattttctataagcgagccccctccacaaacgcaccattaaacctgtacaatctatgacaacaatgggaatttatccaagatgtagacgtagaagtgatgggtcaaagtgatccacagttcacatcagataccattaagtgtttttatagctctttacctcctctagtataaggactcaaaaatacagcttgaatgatccagaaaattgaaggtatcaggctttagtgatacctaacaattagttggatgaggttctgcacttgaagggcacttggtttttcaggaaggaagattttttttcagtaatttttgtattcttactggggtgttccttacactgtattccatccctaagaaaatgctactttttcattatcagttgtattgtatcttgacatctaattggcaatacaccacatttctctataaattatctcgtttaaacagttactttcctagttaagtatatttaacaacttagattctgacagttttttaataaacgtattttggtatttttaattaaaatcagtagagtataaacaaatagaaacacactaaagacaattatgcattttaataaaacaaatgtgcaggtccggaaatgttcatagactcttgattttatttacctttagtattataccaaatgtgaccagtcatttttcaaatttgagcatggattatgttttttttctgcctatatcaaatagtataggggtccaaaacaggtttttagggagttattaagtctatagaaaattatgcttttaggaagtgttgtgcttatgccaagtgggagaagcataataataaaatacaaagtttacaaattatactgcctaggttatacaattactacataattgaaaataaaatttaactgctgtgtacatcatttatctatatcaaagttacctatgcttaatttgaaatcactgtaataatgctgataaatgaaagaattgaattgatttctacattaaaatgtacaattaaacctgctaaatatgcaactgtactttttatatgtgcctttattgtagtaaggatagaaattgttgattgtaaatgtaaaccttatgttctataaggaatgatttcttaaaaagggagtctattacaatcagtaatatcataaaattttaaagataatagatgtttttcatccagttcaaaatgcttcaccatgtgggctttttgatcctatctttaaaaacttttgtgtccatgagaagtataagttaggtaagttttctaagttaactgaaataaaaacacattgaatttcttaaaatcctagcaaaatagtgtaaaataacgtacctatagtcttctctggcacatctttatatgaataacgtgaatcatgtataaatatccttgaaatatgtatttcatttacattgcctcaggctaacttcctctttttttttttttccccctaatagagacaggctctcactgtgttgcccaggctggttttgaactcctgggctcaatcgataatcccaccttggcctccaaaaatgctgggattacaggtgtgagtcacatcacccgactttcaggctgccctcttgatcacacccacaattactgattttttttcaaatggaaatgtattttctaacataaagtataggttagacaaatgcacaccaaatgttaaattcccttctgtgtctagtcatctctgtaattatgaagagacaaagtttaataatatgaaagctgatgaagaaaaaataaccccataatttataaatgtgcattccccagagtgaaaatggctcttggtaacttcatttttaatttcaattatgtattttatataaggaaaaatcacaaaataggctgcttactgtagtgttgaaatatagtgtaatgatagaatgtaattttaaagaaatgtttaaataaataatttagaaaactaaaaatggcctactttttatgatgttaagtatatggaatgctgaattaagagagtaaatttttcttggcaaatagtagacacactagatataggtgaagtgaatgaatatgtagaaaatcagttccttaagaacggctcaatgatgatatttagaatctagtgataattgaaacttagtttaaaagtgaactaagataactaaaatattttcatgtgcttattcacataatcaaggcataggagttaagggtctcctgtcatcgacagccctagagaagttacgaaagacaaatatgagacttttaatgatatcagatattttggggcactgcactgtcatccttttaagcaaactagattctctctccaccacaagcaaaccctaagtgggagatgcaagtacaccttgttctttaaactctggatctttgtattcacaggacaacattcaataaggccacctgtccattgtaatggagatcatgaaataacctaagtttactttttgaagtaatttgggaaatgtagaaaaatatgttcccaggaattttcgtattgggtagaaatatatgcttttctgcaagtgcagtataaaagtatgaaaaataggatggagtaacaggaaaataagttttcttagttgggcagaccatctaggcatagaacctgagtaagtaaattcccccaataattaatcttaaggttcacttttcacatagaagttaagtcacataaagatacactcttgctcctctagctattaaaccaaggtccataatttttttttttacttagtttccactcccagggatatgaaatttagattcttgaccccaaatgaatcttaacacatggatgaaacacttcaaaaagtatagtttctttcctgtttcaccagtcacctgaccaaatcaccttatcaccccttaattcaaaattgattgtgctctctattctagacttcgagtgacccatattttttgccatttgtatttttctttaatttcctagcccactttaccggtcttctcattgtatgttcagaataaaagaaaaggaccacgagaagaatatcctttatggtactatatgaaaacgtggcatgaatatgacttgactaatcatacaaaaatcagtaacatcacactactgtccacagatattgggttagtcagatttcattagtttagtcaggtaatcgagaaacctgcttgaaattaagtgggaaggtgggcacaacgataatcaaattttataacatagcatactgaaggaaatctaaagctgacattaattggaaatgaatgagagtagtagatccaaatatctgcagtaccttgagcagcaggagatgaactgtaattgtcataggccctttaattacgcactgaggaacaactccaccaaaacatcactgctccagaataaaaacaaactataaaaggagagttgcaatgcctctttcttgatgaaagactttgggaagacttgggcaataaagaatactcataaattgtgagtttagtttcctgaagagtctttccccttctctcttgtctattcccacaccactgctagatttatcttcctaaaatagttttagaaacttgcacaattgaaaatacaaaattgacaatcagactaaaagaaggtgtaatagttaggtcacgcattcatggatcttagaatgggacatagtggtcaatgaatctaagaagctctcaaatgtagaattctcatctaagcatccctaacagatgacaagtcaattttggcttagacagtttcagctcattgctttgtgatgctcaaaatactatggagaatagctacaaggaagttatctcgtaaagtatgctgaaacattctttcctatacttctttttatcatttggtcctgtagtagtttactagatcaacacagaatgaatttccccctcaagaagtatatgaataagggaatgatacacatcagaaaaggtacatttcttcactttgttagctcttgttcactacttttagcacagctggcaaagctcttaatgtcatgcctctgtctactttcctattacagaggcattgttgttttttctcgcccactctcaagccacacataccactctccagtcctaaatatgcccttgacttttgtcactatgcctttgttccctctgtcagagatcttccatgttctaaatgtcttcaaagacttctcacccgttaaggttggttctaatgacatctccctgtgcaatctcctaattgcatctttgttggcacacacacatacgcacaaataatatatgctttgttcataaatcacattttattctgcttaaaatagttctttaaatcttgtccatgttcctctccctagttctgtaaaccttttgaaagtaggatctataccttaaggtcacctaattttttttctcttttttaaaaaaagactatatacctaaatcaaaggggggaattaaatgcacataggaaaatattgattttgtccattagacttctaaatctatacacaagaagctttcattattcacatatatccttaatcatattgtatatgtggggtatgtgtgtgtgtgtgtgtgagagagagagagagagagagagagagagagagagagagagagagagaagaggactgaggaaccaaaaagaaaataagtcaggagcataaggaggtattttcttcttttttttttttattatactttaagttttagggtacatgtgcacaacgtgcaggtttgttacatatgtatacatgtgccatgttggtgtcctgcacccattaactggtcatttagcattaagtatatctcctaatgctatccctccaccctccccccaccccacaacaggccccggtgtgtgatgttccccttcctgtgtccatgtgttctcattgttcaattcccacctatgagtgagaacatgcggtgtttggttttttgtccttgcaatagtttgctgagaacgatggtttccagattcatccatgtccctacaaagtattttccttttctacaaaaaaattctaattgacctgtgcacattattttcactttggagaagtgacttctcctcaagtaagccataacaagtgtttgccaaagctagaattagctaaccacttgctcatttgcttacatatccccgaggcaccatacaggacattgctgatactatggaaatgacctacagaagtttggacatttggtgaggaccatttttcactttttttcattcctttctctatgtgaaggaaatttaatagtattatgtattctttaataccttaactctttctctaatgtgtgagagaggggagggaagggaagggaagggaaggagaggggagggaagggaaggggaggggaggggaggggaggggaggagagagagatcaaaggacaaagaaaataaccagagatacaaggatgcaaagagaatttcctttttctacttccaaaatctagttattctgtgcaaaaacgttaagaacgaactttggaagaaaactatgcatggtgaaaatgctgctgtttaaaaactacaacaaaacagcccatcatagagtagaagaaacaccggcctgggaggacaagtgcctgtgttctatcacagagctaatgttaacaagctgctcattgacgaaaatctcgtcccttatatcagactcaatctcctcattcataagatgagaaatttgcactagattatcactgaaatttgctccacctctaaaatgactagggttccatattctggtaaattaaacagagtaatgttttaaattaaagatattatcacaggtgtgtaatcttgcctgttgagcataaattaagaatattttcaaaacgatgtgacattcaatttatagtaacagattcaaaaagcatatttaaaaataaattatagctagataggagaaataagttctagtgctctatacgactgaatggtgactatagttagcaataatatagaagtttcaaatggctagaaggagaacgttgaatgttcccaacacaaataaatgaccaatgtttgagataatggatatgctaattaccctgatctgatcactatacattacatatataaaaacatcactaggttctccatgaatatgtacaattattatttgtcaattaaaaaaattcttcaaaagtaaacaatgtaaaatagtagacgtgatgtgaggtataaggagaacttcccaatcaattttggaacataaaacttcatttctgaggcaaaggaagaacttgacattttatataacttctttgccagaatccagtggctctactatttttctgaagaatgcataaaatcacagtatcatgatactttggaatttaggaggctgctatactgagtttagtcctgtctgtttgtatctaacaaagaaatctttctttttctccaaccctcagtttctccatcttggaaataagaaagttagatgtaatgataacatgaatgtccttacctcttaatctttcagttttatgtgatcatatgagtatcttctctctgatcaagcagtctgcttagtgatttgataaattaaatgataaactttcatttgctttgaagtgttttttattttgtttttgtcactataaaaataattaatttttgagtatttacagcattgtccttccaactgctaaagaaagtcatgtccttgccattttcttcctcaaagacttagaaaaagaaggacaaactaagcccaaagttagcagagggaaggaaatattaagattagatcagaaaaaagccaaaattgaaatagaaaacaatagaaaaatcaacaaagctaagagtttttttaaaaacaaatcaataaaattgacaaatctttaggtagattaagtaaaaaaaaaaaaaaaaaaaggaaaattcaaataagtaaaatcagaaatgaaagaggagacattacaactggtatccaaaaagaatgcaaatgattataagacactgctgtaaacaactgtatgttaacctagaaaaaaatgaacaaattccttgaaacatgcaatctaccaatattgaatcttgaagaaatagaaaatctgagtaggccgaaactagtaaggagattgaatcagtagtccaaaaccttccaacaaagaaaagcccaggaccaaatgtcatcactggtgaaatctaatgaacagttaaagaagaattaacaccaatccttctcaaattcttcagaaaaattaaagagaagagaacacttccaagctcattctacaaggggcatcagtatcctgatatcaaagtcaataaaagacactaggagaaaagtacagaacaataccgctgataaatatagaagcaaaataactcattaaaatactagcaaactgaactcaacagtatattgaaaggattatacacgagagccatataggatttattcttggaatgcaaaaatggttcaatttatgaaaactaatcagtgtgatacacaacattaacagaacaaaggctaaaaatctatggtcatctcaatagctgcagaaaaagcgcttaacaagtttcaacactttcatgataaaaacacacaacaaactaggaatagaacgaaattaccgcaacataataaaaaccgtatatgaaaaacccacagtgaatatcacatttaatggcaaaagactgaaaatcttttcccttaagatcagaaacaagacaagaatgcacacttttgccacttcttttcaaaatcgtaccagaagtactagccagaacaattagataagaaagagaaataaaatacatcaaatttggaaaggaagatgtaaaattatatctgtttgcaaattagatgatctgatacgtagaaaatcttaagagtgacgccacacagagacatggttagaaccaataaacaaattcagcaaagttgcaggatacaaagtcatcattcaacagttgcgtttctatacgctagcaacataaaaacaggaaatttagaaaacaatctcatttacaatagcaataaaaagaataaataacttagtaaatacccaaccaagaaggtaaaagatgtgtgtgctgaaagctatgaaatattgttgaaagaaattgaagatgacaaaaataaatggaaatacatctgatgtgtcatttaaaagtctatatatccaaaccatctacagatacagtgtaattcctatcataatcccaatcgcattttttacagaaataaggtaaatttcctaaaattcatatgaaaccacaaacgactccaaatagccaaaacagtcttgaggaagaagaataaactggaggcatcacacttgctagtttcaaaatgaattaccaaagctacctcagtcaagagcgcacgatagtgtcataaaggcagacatatagaccaatggaacagaatagagatcccagaaataaacctagcatcaccttcaataggggtgccaagaatacacaactgggaaaggatatcctcttcaaccaatggtgctgggaaaactggatatacacattgcaaagaatggaattggacctttaacttaaactatacataaaaatcaactcaaaatgaaatggagtaaagacttaaaaataagatctgaaactatgaaactcatagaagaaaacataagggaaaaatttcctgacattggtcttcacaataattttttttggatatgacgctaaaaggacagccaacaaaaacaaaactagataagcagaaatatatcaaactaaaaagcttctacaaagcaagggaaacaatcaacagaattaaaagcaacctatagaatgagagaaaaggtttgcaaaccatatatctgataaggtgtcaatatctaaaatacatgaggaacgtaataacaacaacaacaaaaattcgaacaacccaatttttaaagtgaacaaaggaattgaatagatatttctccaaagaagacattaaaatgaccaacagttatatgaaaagatgttcaacatcactaactaccagggaaatgcaaatcaaatccacaatgatatactacctcacggattaggataaccattattaaaaaaaaaaaaaaaaaaagcccaagatcattacatgtgttggtgaaggtgtaggaaaattggagatgtagactgctggtggaaatataaaattgtgcagcttttgtggaaaacaatatggagtttcctcaaaaaaataaaaaatataactaccataagatctagcaatcccgcatctggatatttatctaaacgaattcaatttaggatcttgaagagatatctgcattcccatgtttattgtagcatttttacagtagccaagaggtgtgaacaaactaaatgtctattgacaggggaatgtataaagctatgttatatacatacaatggaatatcattctgccacaaaaaggaaatcttaccatatgctacaatgtggatgaatcttgtagccattttgctaaataaaataagcaagtcgtaaaaggacaaatactgcacgcatccacttacatgaggtatctaaagtagtcaaaattatagaaacagaaagtacaatggtggttgctaagggctggaggagggaagaaatggtgagatgctgtgcaatgggtatagactatcaggcatgtagggttaaaaaaattataaagatctgctatgcaacattttgcttatatttaacaatactgtattgtgcacttaaaatttattaagagggtggatttcattaaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatgtagcataagtgacctcgtaatgaactgaaatagatattaagttgatattaaatgttgtgtatcaacggcagtgtgagatcattgtgaactagaatagtgtagcatatcttttggactaaggtagattattccaggctttaaattccgaaatatttagagagtaagaaggacatagagagaccattcagacaacagttgcaacggaagtagacttgaaggccagaaagagctcagcatgcacagggataaaacaggaagagcccagtgctaaggattcactcaggggaagggtgggtgataatactggatgcttaagttggtataagatagtaagatacctgaaatatgaatctgatgttttagttttttaaagaattttacaaaacagatttttaaatagctgtagagattcaaaagagaaacgaagcagttgtacccaaaagtaggataataaagatctcttgattgtgttaaattataaatgcatactccatccatagggtgatgccaaagaaggaggaaacaagtagtttgttatttgtcttcaatttatgctatgcttcttctctgtttgaagaagttgacctgtctgctcgaaagccatatccagcagacccaccgattacttgcacagtgacagaatttaagggtcaattatattcatgaactaatttatttccactgagtttactgatgaccctagaaaatttaagcggtgacacaggactgtaaattctttgttgcattataaagctccttcaagaaattaaaatgcttaagtgaaaataatgatctatccaactttgagtggtttccctacactttttagtgatcactttctggtaagagacctagaaaaaaactgctgaatgaatcctcaatttgtcaattttttggaaaaccaataccttctacagctattgaaaattcagagggcagtttgcaagaaacttaatctatatcatccttcctgcaaccttaccacagccatgattttatcttcatttaaagcacgagattgaaagatgcattgtgagagaagttccggtttgctacttccttcattgttatttttaatctttgagatatacaataaagcatcattaacctgaaagaaagaacacccctccagaacacacagtaatcaatggcaaagttaattggaattgagttcttttaacaattccaccttagcaattctacaatgttcctagtgatagacagttttaatcaaagcttggagtatttgaaaaagagacaaataatgtaaggaaggagataatttgtgactaaaacctagtctttccactaaggatttccttttctttaaagtttcaggtttggagctgaaacactttttgagtagagaagacacaggatgggacagtggttgaaaagaagttggtctgggtgcaaatcccaactgcagcatgttagctgagccatcctggacaactcacttagcctctctgtgctccagcttctttgcctggaaaatgggaacgataataaaacgcactttggcctggcacatagtaagccttcaataaaactatcactatcatttttatgaagcaagataaagcattcttcttgaaccacttctctacattttttttctgaaaggttagagctcaatgagaaccataaccccaggccagggcagagtaaagaaagatatacaattcttcagatctaagcagttgtttatggatacctcaaaatgattgtaatattaccaacatacctaaaagaaaagacaggtgggtcaggctagtacatgtttacttcctacactgaaagcattttgattgatgctattctgactcttccaaattttaatggctcctgttaaccaatttcacctgcacactgggctcgtattcctcatctcagctggtaagaaattaaagtgtctcagtacgatgacaagaaactactgagcaggccattcatcgttctgaaaacagtatgaaacagctatcatcatacctctataaattaaaatgttattttctttctacagttgtgctctgactacaagcatatcggccattcctggtggggtccagttcattatttcagtagacgtaaataatttttagcacaggtatttgaaattagaaggcgattcagcattggaattgagaattgtccacaccactgcttataaccttggaattaagaaatgtggaggtgccattgttccctggggtcatttccatcattctgtaataggtcttttgtttttgttgggactgttgtatttgccacctttggtcaaatgaatctgaaacaattctatagctagagcaacaccacgaaagattgttttgtcactaaaatgatgagctagaaaggaaacgcataggaaaaacatgctcagccttcctatagctaagaaaccaatgtacggaggccagaagagtagttcaagttcttcagaagcacatgaactctttattctaataaattacagagtccacatgtgggagatgcttcactatttagtgaaatcatttcacggaataatatagatcaatgtttctcatgctgatttctccaggtcttagaaatctgaggtgtcagttttaaaatctcctggaaaatatgtgtacacatattcagggtcattcagctcaactgaaactgatagctgattacagtgttcctgctttgttgatatttataaggtctggcttcgtatcaagcagttatgtaaagtgtaaagaattggtgagaatgaacattatgcaccctccatgaaagaagaccaaatgacaaccaattgtatgaagaaatgttaaacacaattagaatggaagaaaacaagtagatgaggagttagtgaatgctacctaagaatacagatattaacctagaaatatgttcttgaataattacgtgacaagagctagacacagaataaatatatcatataatttcatttctattttaaaaggaaagtttatataaaattctatatatgttatatatattaaaacacgttcatatgaatacagataaatgtcttgatgtgaatggatgattcacatgaacacttaagaaagttaaatggggcaaggcagaaatgtatcagctctttatacaatactatttttaatttgttttaatgagcatgtgttacttttgtatatcgggaatacgtttcttaaaaagtataagtaaaaaggattttagaataaatggaagttttaaaacaagcagcttgccatatgaagaattcatactagtctttttggatgaatgttttaaataggttaacacgctcagtaaaatttaatctgcacaaatggctttgtcttacacagagaggatctatgtggaaaacagaaccaaaagccagtccaaacaagtaaaacagaaactgaatgtagagttggaactgatattcaattttggattagaaactgattattgaaaggaaaaaaaaacacagtaatttcagatctgctgtttcagtaaacctgacactaatctgagttttttaaaaaaattaattctgacaaagcttgagataatgttttaatagtgagtcactacaaagtaactattaagtattcaacattcaattaagtcaattcagcttttgatgtttcagccaggtaaatgctcaacatgtgtggatataacacatgttatacttttccatttgtgcagaattttctactcaaataatgttttaagtatgtctaacacacacacacacacacacacacacatgattatatatccatatccttcaacaaaatctgaatatgccttcactataaatcttttgattaggttagaaaagacaatctatcctttggagtgatcaattgcctatgagttttgtccccctcaactgctgcttagtccataaacggaacctcagaagttctgctggaagctacagttgaagtctttctataatgttctcgttgctaagactttagagctagccatagaaacaaactgcaaatgttatttatgctttatgtagtaaaatgataacctgaatataagactgggtctcgattatttgtttcatttatttccacactccaaaaagtctagatccacaaaatgcaaacctaggattccacgcacaaaagggtgcaaacacgaacttttatgattctcatatctttcaaatatacttatgaatagtttattactatgggacaggtatggataagtgtcgatttctttactttttattattttttgtaggtacatagtatgtatatatatttgtgggttacttattgagaatccattcaacgagtatacaaagatcgcggatattaaaactgaaaagaaagacaacctggaagttaaaatgtttgacattaagatttactaaacagaaagtttgcaaaatttcacaaactatataagttcatctgatatgatggatgcttccaattgtagaatacagaaattatattcttgagtttacattttaaacttgtgagatgtttggactgaatatataaatagaaatgacttaaaaattttcatgaatattttcagtggatactattacaaagctcaaagtggaggttaaaagttttgactcattcgatttattctcaacgaatgaattatctaatatttcaatgtatatgagataaacatgtttatattagaatgtcaccaattgactctttaatatataaagccttaattatgtttaatctataaaaccactaatgttagagactattcatcacatattcactataagataaacactatggagaaattatgcataaatgtgttacattaaaatactattaaaaagacaatttctatgtgtgtgtgcatgtgtgaagaatcattcgtttctctatccacttgactacttgtcatttctctgttatatctaagtgtaaaatgcagacataccagaatttttgcatgctgggtttctgggctttctaggtgataaaagtgcctaattattccaaactgttagatcattaatcctagccacaaaaacatctacattaatttaaaccttggcaaacgttaaacaagtaaattacgaaagtatgagccatcatgtcctacttctcttccattgtttctcagcatcttaaaggattttatttacaaaaacttagtaatcccttaaatacatttcttcagtatatctgaatttcctgtttgttgtgtgtattgtatgtgtctgtctgtatgcatgcatgcccatgtgtgtgggtatatggtgagctaaagaggcaaacagtatatacattagctaactacaagttttctacccaaattttcccacaggccacactcaacccattcttaaaatgttgcttaggcattcatcttctccttcaggataatgggggaaaatgcttatgctttttatttgcttcttgtagataatgaaaattttattattcaccctagcatgctatcgatgcttcagctgatcctttaaacatctggcctactgtttaaaatgcatggagtgaactgatgtcagcccgtgctgataatcagaggaccttcaattaagtacctacgaagcaaccaatgataaaagagaaaagacagtgcaagtttgccaaagaattctttcatagtctgattctcaaaagcaattagaatcacttcttttggccttggaattaatgaattttcattaaaatttaaatttcaaatgattccaaggatatcaaacttgagaagttgagctgattgtctacgtaataaatcacaccacaggaacatgtcaaaaagactaatgcaagttctttgccgtccaaagttttgtttctccttgtcagtgctatgtgaacatatataattgctttcttttcctggaagcagcttacccaaagacctaccattattacactccgtatttctctctgtttagaatttttgaaatgataactccaagattaattgaaactagttcaagtctacaaaacaagtttgctctcataattgaatgtgatatgatttttataaattgctgcagttacattcttcacactgtaatttgcttaaatgaggaaataaagttgaacattctaatatcaacatatcctgtatttgaaagtgacatttaacttaataacacagacattgtctttacttgacagaaaacaaaatacattggatgtttgtgtatgtgtaaagtaagtgttgtattttggactgtacagaagtataaccatgaaaagtgctaaacatctttggccatagaaagcaacacgggtgttttgaaatggtaataaaattgagcaataaagcagaaaaataatattcatataaaagtggtcttgtctgtggacgttaaatattttaatcttgaattaaaacagcacaacacgtaagtaataggcacattttgttcactctttaactcattctgacaaaagtatgtgcatgttttcaataacaaatttcacagtacctctttctttcctcgacagtgaatcttctttgtcaggaaaaaaaatctcaacagtctaaagaagaattttcttaaacatgacatatccatatcaagcagccatgaaggaatgtttctagttcttactgtaatatttttcttgccatgtccctcttcacaggtgtactttgaatcagattgattaacttatcagtggtttaattgttcaatatttgttccatgtattaatattttataaaggattttgaacctggggcaaaacctctgcactaaatttcccccatccatcgatcttttccaactcagcatttcaacagaacttaaatcacaggggtgctggcttataaataaatgtataacaataaataaaaatagatgattgtggctttaagatatgttcagagactggaagaaagagcagaagtccccaactgaccatcgaactgttctaatgtccattttatttgccccacatagtgtttaaatatttcagtatatagtcagcttggaacctcttgcatagatagcccttactacttcatgcttttctgttacctgactacccatgtgtacattttgttttgcaacacctgcattagatgctgacatgttgattatattgtattatactgacactgcatgcctagcctcatctcgtccctactttcacagctgagatctagagccctgttgcaaaaacattttaacctctgtagagagcagggcgtttttgtcttccgtttttacttgtaggtatcattaagtcccctatatatttgggtgctgaagagataataataatgaacacacttacgaaataaataaatcagctcatcatatggtgactggaattacttctgtgcgcacaaactaatgctaacatttttcggatgcacaaaacatgtcagtacatagttaccaacgatggatggatagaaatattgttttagaaagtctgagttttaatataaaaatggatgagagaaggaagttcctaaattcatacaaatcacctatagtggaaatggggatatgtagaaataaaataaattaagcttaatatttagtaatacagttaaaagcaattcaatatataacccatggattgggatgatttttcagtctactgcttacaatttcagtattaacatgctcttctcacttaaaacattagaaaaataggttaaaaattttcagacacatggacaaagaatgtttttatctttctgacagattatcagaatatgtaattattagttcaataaataaagaagtgactggtaacaaaaatgcaaaagaattcacactgtgatcaaagcagaataggatctccgacatgacttgatacaaagaatacacttccaattcacccaatttttatttttatgtataatacattagatacttttagtgaccacgaatatttatatgacatctttttttttcaacttttaagatccagagggtacatgttcaggtttgttacctggatatatggcgtgatgctgaggtttgggatacaaatgatcccattaaccaggtagtaagcatagtacacaataggcagcttttcaacccttgtctccccctttcctttccccttctattagtccctagtttctactgttgccatcttcaattctataagtacctaacatttagctccaactcataactgagtacatatagtatttggttttctgttcttatgttaatttgcttaggataatggcctctagctgcatctatgttgctgcaaaggatatgattttcttcttttcgtggctgtatagtattttatggtgtatgtgtacaacatttactttatccaatccaacgttgacggacacctatgttgatcccattactttgctattgtgcatagtgctgtgacaaacatgtgagtgcatgtgtctttttggtagaaccatttgttttcttttggatatctactcagtaatgggattgatgggtcaaatgatagttctattttaagttctttgagaaatgtccaaactgctttctacagtggctgaactaattaacattcccaacaacagtgtataagcatccccttgtctctgcggccttgccagcattgggtgtcttttgactttttaacaaagccagtctgacgggtgtgagatggtatctccttgcggttttgatttgcatttctctgatgatgagtgatgtgacgcatttttcatgtttattggctgcgtgtatatcttcttttgagaaatgtctgttcatgtcttttgcccattttttaaatgatgttttatgatttttgtttgttcaattgtttaggttcctcatagattctggatattacaccaccgtcagatgcataacttgcaaaagttttctcccatttggtgtttgtctgtttactctgttgatcatttattttgccatgcagaagctctttattttagtaagtccttgcttgtcattttttttttttttttttttttgcaattgcttttaaggacttagtcaaaaattctttcccaagccaatgtccagaatggtatttcccagattttattctaggattcttatagcttgaagtcttacatttaaatctttaatccatttcccaatgcttatttttttgttgactttgtcgacgaacagttggctgtagctgtgcagttttatttatgtgttctctattctgttctattggtctatgtgtacatgacatcttggtaggatttcaaacctgttcaatgccctaaaaaaatataacttttaagtgatttgaaaaaaactgcctgctaaatctaaacttggaaactgcctacttaattctataatgagaagggtaatctcagcataaatttcaaaagttaggctaaactccatatctacttgacaagtaaccatgagcttaaatataatctgagatcacccaccataatatggaagtgaggtaggtgagattggatggtttgggagtagagatacaatgttataaattccgaattggaacatattgacctgacaactgggtagaatatttgcaatcaatattgttcagagacattttagtcatttggcccttctgtaacagagtcatagcccaatccttatcatgaaatacctgggacaaagtatctgaaatgttaaaagtttgggggacgtaattatggtttgtggtggaatcgtaggcatgtatgtaaaatcatggctgtccttatatttgaaattctatttacttccttttggtatgatggcattgaaaagaagaaatgataagtgtttcagatggtggatatcccaattaccctgatttgatcattacacattatacgcttgtatcaaaatatcactagaatcttagaaatatgtacaatctctatgtatcaacacaaaaataaaataaaagctaaatctaaatatgtttctttagaaaaaaggaagaatgtcagatttttaaaaggtaataataattattttataggtaaaaatatttttctcatatacataattatggtagaattgagtgttgaatacaataaaatattctaatagcaatagatttgtgggcactgtaactttctcgaagcagcagagaaagttctgtaagtctccaaccaagttttatctatgttatgtaagggttttgaatgcttttctataacatagtttgatcttttttcatttgaagcagtaaaagaaatttcaatgaagcattttaagtatggtgatagattaatgactgcatacaatttcactcatttaattttatttcaccaaattaggcttcaaatcctccagaccatctgtgaatatctggttgacttgtcagagtgcattttgcctgagttcaggggcgctgtgaatttctcactccaatttaaatttaggacctctgaacactgttcttctatatttgacatctgatgggaagacttggataagcaaaaacacattcattacctgcattccagaaattaaaccatcagcaacgtgttgctacattttcaccctaaattgacaaggaggacattataccacgatggaaaaaacacatgagcaaataggctaattaggtgctattggtttagattatctgtcagcagcaggactgtaggtagccacagggagtacaggcaggggaggaaagcaggcttgatctagattcaagcatgaaaccagcactctagaacatgatgggtgtaatctggagcagataaacagaacctgtttcatgatagcatttttgatgattcaggccaatcggatggctaggaagcaggcgctctccccaccccgctcaaactgctgaggaaggtgaaccatgcagttcatcagagggctacaaagaggtatcaacacttcagttttccatatgggcatctggggctcacaaaaccaaacagatttttggtatcaaaaatagtattgcagcctctgtggaaaccacccatggggtttctcatctatgtaacactgacatagtagaaactcaggctgcctagagcacattcagagaacaagtgaatgagtgcagtctacaaagtaagtctctgtcacttacatcatgcttcctgagaatatcacttgcaattgtgaattatgctgctataaacatgtgtgtgcaagtatcaacccaaatgcccatcaatcgacaagtagataaagaaactgcggtatatatacatatgtatgtacgtgtgtctatatatatatatatgaatactactcagccataaaaaggaatgaattaacagcatttgcaatgacctggatgcgattggagactatcattgtaagtgaagtaactcaggaatggaaaaccaaacagcatatgttctcactgatacgtgggagctaagctatgaggatgcaaaggcataagaatgatacaatgggctttggagacttggggggtagaaaaggggtgccgagggacaaaagataacatatatggtgcagtgtatactactcgtgtgatgggtgcaccaggatctcacaaattaccactaaagaacttactcattgcaatagtttgctgagaatgatggtttccagcttcatccatgtccctacaaaggacgtgaactcatccttttttatggctgcacagtattccatggtgtatatgtgccacattttcttaatccagtctatcattgtcggacatttgggttggttccaagtctttgctattgtgaatagtgccgcaataaacatacatgtgcatgtgtctttacagcagcatgatttataatcctttgggtatatacccagtaatgggatggctgggtcaaatggtaattctagttctagatgcctgaggaatcgccacactgacttccacaatggttgaactagtttacagtcccaccaacagtgtaaaagtgttcctgtttctccacatcctcaccagcacctgttgtttcctgatttttaatgatcgccattctaactggcgtgagatggtacctcgtggttttctcagcaaactatcgcaaggacaaaaaaccaaacaccgcatgttctcgctcataggtgggaattgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatacgtaacaaacctgcacgttgtgcacatgtaccctaaaacttaaagtagaataaaaaaaaaatctcagaaatatcaaaaaaaagaacttactcatgtaaccaaataccacctgtaccccaataatttacagaaaaataaaataataaaaactaaaataaaaaagaatatcatttgctaggagtaaaaaataaaacttcatcttgaagatcataacaaccctagatgagaaagcaaatatattacctgatctttttattttccatcctcattttctcttcaatgatatgtatgaagagaaatattaatgttagaaaggtaatgcaacgtgttagtaattgctctggaattgatttctctattctgttggcatttatcagaattatttaaatttcaaagcacagtctaagaattccatgagataaatcttattgtaaatgaattatattaccatgggcttgctcattatttgtgaaagtgactttatctgcctggcttattattaaatatagtttatgaacaaggtggcacatttccttctgtttgatttttgtaaagaactctgtatcttgagcggttgggtgctgatatacgtgccacgatatgtaatattaaaaaccctttgctctccaatgacattcttatcatttgaagtcatttcttaatgtttctacattatttttaaaacactgctcttttgagattttaaaattgttatttatattgcaatattttatataaattaatttactccttaggaggaaactatatagtgaacaaagattttttatttaaccttttcaaaaataatatcttctatttgggaaaaaaaaaaatgctttacaaaagaggttccaaaacccagaggggcccacagtcattgtgttctttcttgactaacgaattccttgagtgcagtttcaagtacagattgtagtatctatcaatgtcttacccaattttccctgtcagtgtttcaaatatattttaattcctgtaaaataatctgggatgtggtaacaaattatcatatatacattaagaaaatttggttcaggacaggtccactgataaagtttcctggtgtgcccgatattctagtaattccttaatagaaacctaagagaaattagctcttttttgatcatcttaggtagcctggggaaaaaaaatcactccaggtacagcatcctttcctattttctcatttcctttaacatctagttttattttcttaatgctttgtcattttgttagtattttcttaatttttttttagtgtttaatactcggcaaaggacagacatagcctgcgatgcaggcagggctgcttctcttaatgttcttttgacagtaaagattcaaaattagcccattatcaaccaacaaataaaggagagggttggaaataagtgtaatggttccggccaaaaataaacacaaggccagtctgctaaattcgtatgttgcaaaaacgtacttactacttcacttagcctttaagaaagacatgggatgaattgggatttttaaagtaagaaggggaaaaaaagcaacactcttagctcctttatccagtactcctgactctgcaaggtagattgtttcctcctctaattggcaaaatgctgcaggttttcagtccctcggtgaaagtgacttaggacggggcattaattctttcagttcactagggcgtcatttggcaaattactatatgtgagcaataaatcaaagagttcgaagatgccttgagaaattctccaggattattctcttgccttctggtaaattagaaacatactacattcaataacaagagtatacatattttatattataaacattatggctaaaaaatcatggaagaactattattattttacaaccccctctttttaaatgttttcctaaacatacatggtatgtatgtatatttcaaactgtcaaaaatccctggattgcaagtaaaattcaactatcccacttgcaaaatgaatgggttaattgttcttactttagactcataagttttcaaagaataatttaaactgttaaatatttaaaacaaatatactttatttggtgacttaatagataagagaatagaattagttgtgaacatttatactaatcaaaataatgaactactgtcattttgaattgacacctatataaattctgatttaaacatatttttacatctcagaagaaagagcatagcgttaagtataagaacccatttcaaccatagattggcatagcaattatctgatcttataaggttaaaaatatgagaacattttcataatgatattaaagtattaattagtaaaatagttgctcgattatattccataaaaatagatagacaaagaaaattttaagataaattcctatgtagtaggtaaatacttttccctcaaataagggaatacattaaggagatgaaaaattctcaaactttttcattttataaataagaaaaaaataatcaaccatataaaaaccacatgacatcaaaagctatagttctaaatgctagccatagaaatgcatgattatattatgatactatttatctgttcataaacatgacctgcctccccagtgcaattttaggaccaatgaaaaggagatcctacatccttttaaatttccccgaaccctagtgcatgggaacaatatacagtattttctcagaataaaaatcaggatgatgaagaaacggcgtttactatgcaagggctgaatacaaagggagattagtggactgtttggaaaaagagaatgattattactgtttactttaagacataaagtcagaaactatagcctgtgtgacaactcgcatttgctgcctgtgtgcgtatggcacacaagctaagaatgggatttacatattaaatggttggggagaaatcaaaagaataatacaactttgcaacacataaaaattatacgatatccaaatttctctgtgcgtaaagtttgctaggaacaaaaccatgctcattcaggtatgtattgtctgctttcatactacaacagcgtagttgagtaattgcgacaaagacgacaagcctaaaatatttactaactagcccttcaaagaaaaaaggcttctgactcctgctttaggagaaagcacgtacaaggaggtaaaaataaacttttttttttttaattgcaatcagattccagatggaccctaagagctcagttacggaagtggaaggggaaaaacagcagcagcagcagcaacaacaacaacgacaacaacaacaacgacaacaacaaaccgaagaggaaaagagagctgagtggaaaaagtctttgaaaatttagtcctaaaacttatatttacattctcatgctctcctgaagtcacagaaagaggttcggaacttctgctttaagaggacatttgaatcgactggagaggaacaaagcattgaagagagaggaagtgaactcctcagataaagctctaatatgagaaacatagttccagagagaagttaatgttacttcatttttctgtctcatttccttcaagctcaaagcatgagtaagtgataatggtaagtaaatatgtattctctctgccatcctaaaaacagaaggagggggaccacttgtaaaattaaacactggctgtaaaaataatttatccatatgtaggatttttttcagttggagaaagcacccaagcctacagagtgcgtgcctaggttctgcaataacaatgcaatagaaacagtcacaattaacatacaggcacacaaacacagaaacacattttcgtgctttcactatagttacttatgggaaaaaatcaaataaaatgagggcattggaaggcaaacaaaacatgcagatacttattttttgacaaaactttaatgtgaagttattacaactgtctgaaaatttaactctccaacaaggtctttcttgtgaaaccgttgtttatcttgcaagttcctacagattctcaattctgtacccataattttcctatcccttgaggcctggtaaagttttcatggaaaaaaatgaatgtttttgagattctacatttaatctcttaattattctaaggcaataacatctttccagtgttacagatttcatgccaaaaaaaaaaaagtttatttagggatgcgcgcagcagctgacgcctgtaatctcagcactttgggaggccgagtagggcagactgcttgagaccaggagttcgagaccagcctgggcaacatggtgaaaccccgtctccactaaagatacaaaaattagccaggcgtggtggcagacacttataatcccagctactggaagacagaggcaggagaatcatttgagcccacgatggggaggttgcagtgagctgtgaccatgccattgcactgcactccagcctgggtgacagaacgagactctgtctcaaaaaaaaaaaaaaaaaaaaaaaaaaaaaaaaaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttagaaaccaatgctctggataacatccctattttagaatactcaaagggctgctacagctatttttttttttggcagttccattctccacaggtgatctatagcttgaactaaacctaaagccatcagattttccaggtttaaaacattttaaaatggtcccatctaatccacaggtttttaaagttacagttaataatcatgttactgaaaacatacactagaagaaatgttatcaagacattaattaaaagtcatgttgttaaaatatatacaagacatacactagaatttttaaaaatattattcacatactaataaaatgaaagtaaggaaataatacaataattacaagaacttcaagaatttctcatagctagtagtgaacatactgatcagtataagggcttgggggtttattaatatttctgaggcataactgtcttaaaaagagccaaaagtgagatctgataatttatcagattgtctaagaaaatgttaatattcatcatctataaaatgactaacttttctttggtgtacatggttttcaagaaaacatgattcattatttcaacatttaaaatttgcctagagagcagcagcatccctgacagactggctcatgctatgattcggtgtcaggatgaaaaggctggcttagagacatgttctgggttcaatttccagtggtttaaaagatttcttggagttaggttgtgcatgataatgtgcctcaatctagaagaggcatgggcaactcccagcatgcaagcagagctcctggttaacatctgaaagtattcacccacaccgtaatccgctggtttattccacctttatgaaactcctattacatttgtccaccctgtgcttaaagcagcaacagcttaaaagagggacacttcagacaaggccccttctgggtctctttctctttcagtaccgcagagaaaaagatacaatggaagcaacagcagtagatggaatttttatttgaaacaccaccactaaatagctttcagatgaggaatacaattctttggtatttctattttaaatagtgcaggggctgggctatgagattttcatatgctatctcatttatttcatttatctatacatgtttaatttagagtgatgatgtaacattggatgtggagactccaaagctgaataatgtaatatatcaatacaatacctgcagaaacagctatgcagtggagtattttggttttatacttcctcaaaaatgttcatcacgttattttcactttttttttttttttttttttttttttttttttatagaaacacaggactggctttggagttatttaggggaagagtgcctttggtctttagagaaatcttcctggacaattcttgtaacaaataaaacatcaaggtgtaattatataaaatcactattaaaacgcaacttatttgtactatattttagctgttttaacactaagtgaccttacactcattcattgtttctattgctccctgttattgttcctttctaaaagaatgttctcccttatatactgtactatcaccactacttaattagtttttgtattcaatagtcttgctcattggcgctaacattaaagtatgaaataagttaaatataatggaaaaaataatttcttactttaatagtcactttagtcttcacaatagaattctttaaatctataactcaatacttaacagctgagaagaatatgagtgtgtttaatataaattaaagcagcaatttctgtttcataccacattttcttttcaattcatccactgatggacgtttaggttgattccatatcatggctagtatgaaaagtgctgcagtaaacatgggaacaaagctatctcttcaaagatactgatttccttttctttggataaatgcccagtagtgggattgctggatcatctggtagcaattcatgttttattaagaaagtgtttacaacacagaagctcaaaagccttcagctatctctatacaatgccattttaaacacctttggaagattattaaaatatgttaattattttgtcgaaaaactaaaaatttaaaaagcaagacaggtcaacaaaggccagattagaaattaccataaattattaaagtcataaaacatactgaaatctttgggatgtaatttaacacatgagatttacgactactcaagaagcatactatgtagtatgtcacttttgtgctttgagcaaggaacatactttgattcctctatttcagtgggatgaaaacagcttgtgcctctagaattaagacaatggcccacagaattaataatatgataatgaattaaattctctatatttcacagaaaataacaaattttttatgactgtcaataaaaccctcagatagttcaactctgtataactaacaagaaaaattagtttaaaatgtcattttaaccctcctttaaaaaaaaaagcttatctaaatttactggagatatcaatgaggttacggagaattattttaagaaatgtaaaaaggaaccacaatggttctttgctcattaacaaaatgctacataactacaagagatggtttataattacaagaggttaatcatgctttgcaagttgtaaaatttactctcttaggaaataatttcaagagtcctactgattgttaacaggttaaaaaaccttcaacgtttgttaacacattaaaaagtcttcacatatttggcctttaccaaagtaggcagtagtgaccatggtcacctatactttaatagtttttagaacaacttatacatagttcttgaaatggcaataagaattagtggcaataataaataaaacatttatgaacacacaatattgttaaaactccagtgttcacttagatatgtaatctatgtaacaatattgcataattgaagagtttgccaagataattactgatgtatatatatttttcttcatttacaaatattcatggcaaatatgtaatatcaataatgccaaaatgtttagttatttttgtgagatatctcaatacacaaaacagataatagaaatataaattaatgtttgttagagtctatttattttagatacacatctcttccttcaacagcattaagaaatacacaatctccagtgtaggacctccttatagaaaaacattctatcactttgcatagggttattcagatgtgcaggaaagaaccaagaaataattattggttatctattatactaaaattcataggcctgaagggtacatcaaaataggaagatagccaagaaatggtgttcattttcaagtatctttactcaagctaagtctgtaagtcatgtattcacaaaacgatgcttagtggcttgtggcagtacactgtaaataccaaatgagctgtataggactttcaggaaatgatggtttttgagagagtaggtgtggcaggtcttcaagggggcaatgggacttgagcaagtgtcttgtgatgatgggtgtaatttgtaccttgcatgagggtaaatggcgaacaggagagcatggggctagaaaaacatgagacaaatcagaggacagttaatgctggcatttagaagatgtgctggaggtgaattaccaaaagagtctgaaagggcttggagattattcctccttccagaggtgaagaaacaggcccagagtcgttgcataacttgatcaaataatagggccctgtctttttgaatcatcgtccactgcctcgagctacttccatttcctctattctttcactagttaaaatgtaccttttcactttgtgaaaatgacgtgagtgagagtaatagaaaatatctcgttatccatagtttcaagcctagatttgtggaagtcagaatgacagtttcttttaatataacaagttttcattgataaaattattttcagaaaattctctaagtactcttgagttggttaaagtccttatttccctccccaaagaaaatcttaaattcctcgagaccaggtctgtgtatgaatcatctgaaatcctccccaaagggatggataatgcctttgtctaaatgtaggtgcttagtaaattatggataaaagttgaacagcactggcaacaataattcacatcaaagtacattctagttctttatatcacatagaaataaagaattttcttataaattttgtaaatgtgaaagaaaatagaaccaatttagaaaataaatgtcaatcttgcattttaattgttgctcctttcacattaattttacaaaaacttgtttctgatttgattttctatggattaaaagcattctgtgcagttggaagctcattattaatcatgacaactgtagtggctgctagtatgaattaagcacatataccatgtgcctagctaaatggcaagccattcagatctctttctactacagttgattataagtttttttttttattatactttaagttttagggttcatgtgcacaacatgcaggttagttacacacgtatacatgtgccatgttggtgtgctgcacccattaactcgtcatttaccattaggtaagtttttaagagtcaggcatgatatcttagccatctttctatccaaaatgcatagcatgatccctgacatgtgtcatgtgcaatccaaatttaaaaataataaatcccctaccaaatacatttccattaaatatttcacatgagttatctggtttaatcatcccccaaacctcactttacaaatggagaaacaaaagtttcacaaatgtaacacgcccaatgccccacagatagaaagtggtggagccaaggtttgaacccaggctctttgactccagagcccctgcaagaaaatacaactctatgctgccttgacatagctcttcaaataaacagccattcaattatgctcagtgatttcctaatagtttccagaattctagccatgagaaaaataatggttactaatttgaataacgtaagaattatattaccaacaaaaaacgggaggccatgcttaggagacactgtgataacagtagaaagctcaaataaataatttttttaaagttccaagggatccattaaaaaaatacaaaaaaaaaaagtccatttctaatattttattcacagtgacgggcctgagcataacataaactgaaggctcttaccatgttagaaaataaacttaaagtagagatttcactggagagctgaggacccaggtaggtgaggttctgagtgcatctaacagaggggttattagccacatcattcaatcacttaaaataagactatatacgcatagcattagcgagtcaaccatcattaagacaagcggatttttcggagactttagcatgagtccagatgaccaaactcctctgctctgcagatgccatatgtaatgcagatttgcatatttctaatgtattcaggtattactgtttaaaatctactagaataacgacagctttaataaaatagagtttgaatggcttcaatagcaaagaaaattcttaaagattcaagggttcaagagtagtctacttagaaataatcatttaacccccattaatgaacattttttttggatcagtatctacagttctttttttaaagttttttaaattttaagttctgggaaacatgtgcagaacgtgcagatttgttacataggtacacatgtgccatagtggtttgctgcacctatgaacccgtcatttaggttttaagccccgcatgcattaggtatttgtcctaatgctctccctccccttgccccccacctcgcgacaggcctcggtgtgtgatgttcccctcccggtgtccatgtgttctcattgctcaactcccaattatgagtgagaaaatgcggtgtctgtttttccattcctgtgttagtttgctgaggatgatggcttccagctttatccatgtcccttcaaaggacatgaactcgttcttttttatggattcatagtattccatggtgtgtatgtgccaccttttctttatccagtccatcactgatgggcatttgggttgataaacatatataaagatcactttcttatcctaaggaaaagtatacttgtataatgggaccagatatataaagtgacttagttaaaatacaaatcaaccctaagtataaaattaaagggaattctaaatacaacatgtatatggaaatacctataataactaaattcctaatgttgacaaagcacttgacagtttacaaattcttttactatatcatagcatttaataatgttaatgaagtctgtcacgtaggcattttgcatgttttacagttcagaaaatgttttcttccagtaaatctcagctaaaaactgctgaagctagggcttgaacatctgtcttattcccatttttaacacggactgttacattttcatctactttttttgactaataaagtcaatatgaaagtcagtctagattcaggctttgcacatcttctttacaatgctagcgagtttggggcaaccagataaacaccaaaagcactcaaagaacatgaccataaattaaaaataaatccataataaattcagatgctatgctcttcaaggaaaaaaatcaaaaaggggtattgaaaatgtgcctgtatttgcgtgatatatgcatatatatgtacgtaggtacacatatttgtaatttatgtgtatatatgtatatagtttatggatgtatatacatgtaaatgcacatatatgtaaaaatcatataaatatatagaaataaataaagatctatagtaccattttagagaaacaataaagcataatttctggcaaaaaattaaagttgggtataattcaaatatcagtccattatacagaaaaagtaaaagtttgtcctaccttggattttactgattataaaatgaaagcacaaatgattaaaatttctagttttacaccaggtactatactgatggcatgcccaccctgtcttgctaatagtccagttttcataaactaccttgtttgaaaatgagaattttcatgtgaagtcagggctccacattggaaaacactgatgtttctaactcattctagatatttcattctctctttctacccatgtaattttagcattgcttgctcctagcacaatgtttggcacatacttgtttcttaatacaagttctttaactcaaacaatataatcatctcagtaaattcagtgccatacccatactttaccttctcttattctcccggggctaaatatgatcacttcaatcagaatgctcataaaacaaaatcacctgattaatgcaacttatgttttcatgaagtttaaatcaaaatcatttggtttgtttcatctcttcattttaaaacccttttaaaatagattagtctactttattgccttggtaaatatagaatgttgaatattaattttaatcattgctaatgattggggtcattaaaaagttccagaatcgtcatctttacaaatagtctctgagtatactgctgtgcatgttgagggcttaggcctttaaatttgtgaggcaaatctatggcctacagtgtgccctatgaacattgcttttaggaataaattgatgttaagaatgtactagtttacaatcccaccaacagtgtaaaagtgttcctatttctccccatcctctccagcacctgttgtttcctgactttttaatgattgccattctaactggtgtgagatggtatctcattgtggttttgatttgcatgtctctgatggccagtgatggtgagcattttttcatgtgttttttggctgcataaatgtcttcttttgagaagtgtctgttcattgtggaaggcagtgtggcgattcctcaggggcctagaactagaaataccatttgacccagccatcccattactgggtatatacccaaaggactataaatcatgctgctataaagacacgtgcacacatatgtttattgcggctctattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaactggaatacatcattctcagtaaactatcgcaaggacaaaaaaccaaacagcgcatgttctcactcttaggtgggaatggaacaatgagaacacatggacacaggaaggggaacatcacaccctgggaactgttgtggggtggggggaggggggagggacagcattaggagatatacctaatgttaaatgaagagttaatgggtgcagcactccaacatggcacaggtatacatatgtaactaacttgcacactgtgcacatgtaccctaaaacttaaagtataattaaaaaaaaaaaggatgtatcctaccatgatgtgtctttttcctaggactggcataaaataaactaatctggctcacagacaatttcagtttatcctcatttttatcaccatgtgacctcgggcataactaaacatgatctaattttatgttacttctggattcaatgcatttgcctctctctgagatctatttgtaatcaaatttgttaattccatcctgaaagggagaagtaaaaaggaaaaaaagttaacatctttctaacatttcaactttgaactaccccatccccagaagaaactgctattaaagataagttttgaaaactacacaagggccttacattatcttgaacatatatattatttacaagatcacctaactttcttcctcatttaactgaaaagctttcagatagcctacttttttctcacataagtagatgaaaaaaagaaagaaaatcactgtgtattattttcccagatatatatatatatatgtatatatatatatattagctactacggaaaatgtaaatgcatttatctcacaaggaagtttaaagccttggagccatgttttctgtattaacacgtgttttcatcgcttcttcctccacaattgttttttagatttacgctttttcaaagcataaataaccccagtttgtcttcagctgcaatgagaaaacatagcatggtatatatctcttgctatctgtcaatttgcctattaaaatattgttcaccttttctttggagggtttttcttcgcctcctctttcctgactaaagtttcttgcatcccgtgcatccgtcaaaggcttagctttctgttttgtttgttcaaagcccgccttttgggagcttggtcccatctttgcttccctcctgctatcatctccttctaagcattctgtttttagcttcacatctcccttcgccatgcttcttttgcttagaacaataacgcagcagcaagtacatcgattgctttaggaggattttatcttgtactcagttccatgttcctattcattcatttgtctttatttctttaagtttctcgaggcaaatatttagtgttacagatctatgcctacgagttgatgtctggttgccagaattttatcagatacatacacagctcatcacagacaatgtgattaacacttctgcatgaattatgtaaaatgttcgtatcagagtcttttcatagtaaagatattagtgatattatgtataagtgtttatatacattatattttgttatattttgttgcagaacatgttctgagttttcttcttttcacctagatttggagttttaatatggagaagcagtggtggtttaaaagaccacagaatgatgtcagacaggccagagttcaaatacaggttttactactctatggctctatgagcgtgagtaagttaccctagcctctctccagctcaatttaggattactacgaagaagctcggaaacctcacacagggaaaagtcatgtagtgggcatagcacgattagaactataacacaccctcaattaacgttgatacctgctcttattctcatcctcaccattgctattgtaactattttctccccttgcaattggttcccagaatttcacataaactatgaatccagtttgaacttaatatttattgaattattttcttctaaacatttctaattttcccatttcttgaaaagaacttttaccagatgttattcatattgaattgtaaatttaaaactattataataagctgaaatatatcccttggttagaggacttaacactttaccaatataacaattataatcagtaagaacattgcttctatataacattttattacaattttgctatagtttaaatgtgtcccccaaatttcatgtgttggaaacttaatccccaacgtggcagcaccgggagattgtgcctttaagaggtgattgcatcatgagggctctgcccttatgaatggattcatccattcataaattaataggttaatgggttatcatgggagtaggattcatgattttataagaacaggaagagagacatgaacacattagaatactcagccttcttgccatgtaatgtcctgcactgcctcagggctctgctgtgtccccatgagcaaaaaggctctaacaagtctacagccacaccagcctaaacgcgcccactcttatctgatcttggaagctaagtgaggttcgacctggttagtacttggatgggagaaggctctgaccagatgtggcccctcaaccttggacttctcagcctccgtaactgtaagaagtaaactccttttctttgtaaattacccattttcaggtattctgttacaagcaacagcaaatggacttagacgaattctttcacagtataagattttattgacacatagtgtgttgaataaataacagaatgatttcatcttttgtaatcaaaattaagtttgtattagtttcctgtattgttcctaactcattcaaagatcaggtggatgaaggacagactggaaaattttaatgactttacttaaataagtcatttacttatttaaaaagtcacatatttaaatgaataatttggttgtataacacagttactttagaataaaaatattatatctataatattttaaagtaataaataggaccataggctatttatgaaatatgacatgaatttagaatttcgagacaaatctatatttatttaaatgggcaatatggtttgagaacagttgatatgaaacacgatgatgaacccatcttctgatgaataagaaaaacactcaattggcaatggagctgatcatgcattcattgaaattaaattggctttaagttgtactagtcttcttatgcaacgagtagctccttattttgatgaaaattccccaatttataactaagactggatcttgttattttgatcagagatgcaaatgtctttggaaaaaaagttgggggttcttaatcacatgacttatcactgagaatttataaaaacattttatccccttgtagaaatcgatctcaaacttagggaacatataatttagagaaactatttttaacccaacggagctgcatttaggttactccctgtgattacttttgaacttggtagcactcttcttggttagcactgttatttggagacaatatcatacgaggtttatcttgtaggacatgttcagtaatttcctggatagtgttcaaattattaatagctaatcattattccagtgaatataatacagtgtactttaaaagtcatcattatatatatgctaacgataaatgaaaaataatcatacgcagatatgagaactataatgttggaataaagtgcttcattgctgccccacacgcgttagcacttgaataaatgtggatataaagtagaaagaaatattaaatatcaagtgttattccaaccattaaaggatttttactaagagaagaatctttcttcacatgatgactctataacttagctgaaaacaaaagcgcataaatggcctctcctgaagctatgtcttacactccttctgatgacatttcaattataagccgaagctccacgaaacaatcgattcctaaaggtctaacaattgatcactccgtacactgaagtgcctgtaatgactactgtttataaatgttttgctttaaaaaataaggcacactattaataaacagtttgctttaatagaacaaatgcaagttttcaaaatatttatcagaccacgactcttcctgactcagattggcttcagatgtatgtataaggaaggcctattatattcgtaaacactgctaagttgagagacctgtttctagatcccagtaaatagttaagagaaattcacatcattgatctggttgcatcagtttcacacagtgcacaatcttatataaccttttttccccccagtggctattcatttaggatatcctttagaacaaaagaataggattgagtgtcatttagcagaaagaagggagctaagctgacaggcatagtgttctgttgcagtattttgtgttttcatcattggacagcaatgactacagaaccggccacggcagcaaacccctcagagttcagggcttgggagtgggggagtgggatggacaacaactgaggaggcagagacagagaactgcttagcaaaaaggaagaagaaatcaataatgattatcttctctccttgggctactgcaactctgttaatttaggcatgatttttgtactacatattctttgaattggaaaatatatttttgatgtatttcgggaggtaatacataatccttctgataagcaatatttgttgagcattttatctgctctaattatgtcaggtgctttgctacttcacagtaaccacatgataaagaactatgaatagccctagcttagaaataaaagtaaaaactagagaggtaaagcaacccacccaacatcatatacatagtgaagaagctgccaggactggaggccagatttgcctgtgtcctctaatgctaaatgtgcacagggcttagagctgttctgaattctgtaatacccaatgtctccctttttagaaccaacatttagtaacaccctcatttaccaccctgaaatgaaatgaatagatctcataaacttgtctgcacagtgatctaaccatcatataaaaaagaaagaaaataattcataacacaacaatatatgttttattttattttaaaatactttgaaacgtgtgaatgttttcatggccacaccagaagacctattgaagatgccagacacttgcgcctatgttaagaatcccctttaatgtagaatttttcaaatgtcccctgaatataggtgagttgtatggaacactcaagtaccatgagtcgcaaggctattaagtcctagttttctgctatggaaaagagctcctaggaaacttctagaaattgttctataattgctgcattcttgaaaaattcagcaactatcaaaactgcatttcctctcctgtctccctgctccagtaaaaaacatccacacaaaacacgctttgtgtttatatgttaaatggatttacattctaggggaaattaactataaacaaggttttcctctatttgaatgtgcaggggtatgaggaaacactgtttacgcatcatgaagagtctagtcgcttaccaacacacgttagtgccagcagtgtccacctttcatcataacaaccaaaaatgcctcccttgttcaattcagagagaccatattccagcagaaacagaaatgcctcaggtaagaattgtaacattaagagaacatatgcaaagatctcagtgcagtacttttgcactcaacaagcactaaataaatggtagctattagtgaataatgacaattctatatttatacagaattgctcttacaaagcttatattaacagcttaaacagaaattgtaacatttatagcttaaaatgaataaagctatgtgtgatacattaaatgatttaaattttaaaaactgtaagaattaatgtggaaaactggttttaatttgagttatttcacatacacaaatgtttgctcttatacacattttattgcccatatgatagaggtagactttcttctaaaacaatcatattaatgatttaaacaaaaacgtgagtttaatatgcattattattcatgcttcataataatcacctgatctcttcaaatttaactgtcacacaaagctcagttccttttcatggctataaattacatttcagaactttgtgtctttatactgctaataagtcatatttgataatccagcatataataaaaggatcgtgtacaacattaattacaaggtcagttagatgtcaatgtagaaactcattgaatagtatttttgtggaagtagctagactctattatgtttaaacttcaccataatgaataatttgtatcagacttaattcacgagagaaaagtgaaagttctgcggcaaagtggctttttctcccgaaataatgttaataattgaaggctttcaaaattttttcctgcaaatttcagatgtgattaagtgttgactttataaaggctggaaacgtcaaacactttaaagtaaaattgtgttttcatcttaatttaatgatgaaaaacatacttatgctgtctaatagatctaaccaagaatttctgattcatttgattggtctacctggaaaataataaaattaataaaggagagtataaaatgcatattctgtagtacataaatgatgtgtcttttaaaatgtcaactgaaataatattttttaaaatgaagccatttaaaaatgatttttagtgtaaataagatgccagaagatggacaggtataaaattaacctctacccataaccataatttcatagtagttaatgagctcaactcaagaaaaggatagaagtctagtcaggaaaagggtaatgcaaagtgaaacattaaagttaaattatttccctcatttttggtaacaggttattaaaatagacttgaatgggtttttcaatatgaaacactaggatgagctttctgtgcttcagtttcttcatctgaaggagaggctgtctgagtaggggaccataagaatccacttcagcttctgtagtctatgatatatctgcatttttatcaggcatttattattattcccatgtagcagggaatgttctgctccctcccttgagccaggaagtacaatttgtatcaggatctcgaattatgttttgctccatctaatcccagtcatttctctacatatctgtatttttcaccatacttaataaaattatagggatttcttcttgttctaccacttcacttcatggtctccacttgagtaatgcaatcaactggcaggtacaattaccatgaggcagagggaaatgtttcttaggacccaggcaaaactgatttattttcctttgtgccaaatcttacatgtacttttacaccaagttaacctgcttaggcaaagggaggagccatctttttcaagctctgcaatgatccttgagaaagcagaaaagtcaatgggatctaatatttttatggtgtgagttccatctggggacatttgtatggggttgaagaggaatgcatttgatgaggcagtgactgtttgatcttaggtaccacgttcctcagtatgtgggagtgtaaagcttcatgaacaaattatttttagttgagctaaatggctatgagttgatcattaatgattaggaaaaagagccaggatggaggattacgctcttggccttgaagatctctaaggcagtagaaagagtaataaggagtatattagggttccttagagaaacaaaaggaataagagaatatgtatacacacacatatataattatatgtgtgtgtgtgtgtgtgtgtgtgtgtgtgtgtgtctctgtgtgtgtttgtatgtggtaagaaattggctcatgcaattatggaggcaactatggagactgacaactcccaaggtatacagggtgaacaagcaagctggagacccgagagagctgatagtgtagttccaatcgaagtagagcagacttgagatacaagaacagctaatattgtggttaaagtctgaaggcaggaaaaagcccatgtcccagtttgaaggcagtcgggcagaacgattcccttttgctcaggggagggtcagtgtttttcttctattcaggcctttaattaattacatgaagtctgctcacattaggaagggcaatctactttactcagtctaccaatttaaatgttaatctcatctgataacacttgcacagaatcacccagaataatgtttgaccaaatatctgggcaccttgtagcccagtcaagttgatgcacaaaattaaccattacgggcagtgttgacagatcaaagtagtggtaacagtaggtgcaaagtgaacaacagtatcattagaatgtccagggactttttcaattccagaaacatattgactgggtttgatgccccataactttacaagtaacaactattccacatgatactcaatgctcatatgactgccttggaggaataattgacattctctaccccctgtcccaaactttaaaaaacattttgtgtactgaaatgatttaggatgaactgtgaccggaaacaagaaaatagtaactcacggggtggtccaagcaagatgacagccaactttttgttctttgttttgttttagattcttaacgctttagtgaagttggatccacattttgatcattgcaaatattagaaacaacttacatgttcaacaaggtaagattggttaaaaaaaatcagcacaaatacaacaaaatactatcaggtcatttaaaaatgtgaaagaatgaaatttaagagcaaagaagaatctcatgctacagagatttctcttacaaagaaagtcatctaaattctcatggatagaatgcaatagattaattaggaaacagtatttatagaaacaggattgttactcgttaaattgccataaaattagaacaagaacaaacactagcttaaaagagaaaagtgccttttcctgaggacatgtgatacaatgatggcatttacagaaaaatgagttaatgatactgagggactggcaaaaagaaaggaggccattttcatggaaccaaggaaaactatattcaaaggtggtatcttttctctgctattggttttataatcatatacctatagctacacttaaaaattaaaatacttacagaaaatataactttgatattgatagtctgaaactctctaccccaacctcttctcttaatggataattatgtttaagatggttttttaaataacgtgaggttttttattagttaagaacacaaggagcatgttagaatacactgcatgttgtgaagttcagaaagcctgttataaaagagcagtatcttattgccttttcataaacatacgaatgtttaaaattcatatttatataacaggaaaaaagactattaggaaatgtttgaacatgaaaatgtatcaaaatgttaaaagtggtttgctggggaaagtgatattaaagaagatatttataattttttctctatgctcatctatcagcctatacatttttcataataaaccaatattatttgcatattctgaaaaaagtgttatttacttgttagctaaaatttcatgttatttgattcagactgtgtttcttctgctcagtttttggaatgctctctctctacactcaatctatctgagaagaatcaacagctacaatacaattttttttttgcatttagagactctatgcgcccagaataattctgtgatatgtatttctctttatctaaaagtctatatagacaaggggctctgatacatggtttcttctttaagccaccatcgaacatgctgcaggaaagttaatcgtggggatatccaacagagacctgtatcaataacataagaaaatgggaaattcacccgatacttttatttcctagggtgaaaaagaaattagagccaggtaatatctggtataaaaataggtaatatcatacaaaattcattaaagaaaatctgagtgcggaaattaccaaatcacagaatattagagctggaaaagacattgtacagatacagaaatttgaaaaaaaaaaaatacagagatgaagtgatcattctgctgtcctcacagaaatgcctgctacttctattgaattttcctctcatcttcctttaagcatttctggagtgcgtggtgtgtgtaatcataaagttttgtgttaaatgccaaaaaggaggaaatcataaaagagcggtgtaatttttctattatattttgatagtcctgccctctgcataattattttgtttctaatgtctccaacataatctcttaaacatttcttaaaatattttttttatcctaaatgcgagccgactaaggcaacttcttgacaaacacacgtcaaataacaccaacatcaaaatctaaccattcacatccatgaggtaaagaaaaccaaattaaccagtcattatttttcaatggctatgacttttataatagtacagcttagtttctatgcatcctcctatattctgagattcagcgttatacattttcaatttgattttgccagtcaaatttcatttgttcttgtttgattggctgtcgtttacctattaggtgctgccttcaattcatttttacattctctggggagacaacctacacacgaaggttttgccactttaaatgtttaattctgcaacacgttgcagagtaaaatcttcctcgatttatcctatagaagtttcctgtgacaatgcaagtgaaaaaccaaaactcaaagtgtggcaagttggagctaaggctgatcctggaatcaactagtttccacagtaaaaaaagaatgagaatgagacatagattccccacttaaatccaatagaggtagttttcactctgttatcatgcaacagtgtgtgatagtcaatgttgaagtcatataaacaagttatttggttttagcatttaaaataaaggagttctatcaatttgtggtaaacacaactacccatattgttctcttcctttagactctaactggagaagagagtatattttctgcctcttttcccaggtaatagcatttataggatgaggagctggctaatggcttcagttccacatggctagctacactagggggaaaaaaaaagcataatgctgcaagcaaaattccgatgtagtcacaagaaggacattctatttccttttgaaaaaatgtgtttcaggttcttgggtaaatctggtggtagaaagtttaccacctataattctgtaatgtgatcctcctttataaaattgttattacttgtggcaagaaaagaggaggcagatggtactgtgtcagatgctgaaaaagaaagtgagcatctcctagaatattacagtggaagtatccaacattgaaggcagatctctggaatacaaattcagaagtaaataaaatagacattctacaaacagtgaccaaataaatgtctggactgtgaaacagtttatccattgtttacataagaaataatgcggattatattgcatagctagtatgtaccccaaaccaacaaatatattttaaaggtccatcaaacagcccaataaggttccattttcacatacgcatgcagcattttataacagtcctaggatatgtgtatatacagagggatggaaaaaatacagttttaaaagacagaaatttaccctacattttattgccatctgggcagaaacacacgttccattcttttcgtttctccgtggcttctcccaaagagaaataggcctgtttctttaaacaatttttttataagcgctatcccttcttgaagttgagtatagcataacaaatttactaaaatttttttcttaaggataacagtagaataaagaacaatgagccactttgttacagagataagccatgtcattcttttggtttataatgtatttgcccaaaagtattatgtggctagctgatagctgcatagactaactacagctttttactatttgtgatacaccaggttccctttaatcaaacttcagttatctgtatctatattctccttaggataagcctagattgtctaaatttagagcttgctaccaccccagacattctttctttttggttatcatatcaagtcccaactgtgcagcctggaattcaatgtcaaccactttccatacctcacacaatccctgtgattccatcagctctgaccgaatcataataaacaacagtttattatgatgcttcaagtcccatctctgcagcaagtgcttctccaggtgatttaattaccaataatctttttaaaatctgaaaccccagtcccgtttttgcccattgagcagaggctaggatttattatacagaggatattgttttattatctatggcaataaattattctcttgttactctatagttatatattacattctgcaaacaaatttcagatacctcaagggcatgaataatatatttgattagctgatttattggcatagaatgcatttatcgagctttaattatgggccaaaaagtgtactacgccctgaagtcagaaagatgacaaagaaatgttcttggctttcaaggagatcccgtccctcgaattcattctaataatttttagaagagagttaaagaagaatgctctagaccagtggttctcaaactttagtgtgcatcaaattacctagagggctgataaaaatacaggctgctcatctccactctccaatgtttctgatcaagcaggtctgagatgaggcctgaggatctatatttctaatgaattcccagatggtgctgatgttgctggtccagcgaaagagtgatttagagaatggaaaggcaattaaataggcaatgcaaagacacaacgaggtagagggccaactgtattcaagtagcagcgggaaggtcatatggtgggtttagagggtgcatagggtgaccacaacatggcacttggagacgaatagattataataggttttggacatcatggtaatggtaaggaatgtagatattagaagaatcatcatcatcagaaatttgtaaataacggagggatgtgatcacacctgggctttagcttttagaaagaaaacaatagggcagaggatatgtctacacagaggattgtatcatactgatatttagaccacaaagatgagatttgattttctttcaacactgagggctaggtatcatgcttcatatttatggtctgtctcagctttcctcacctggccaattttaacaacctcctagggaaatcacagcctccagtccacctcctctctccctcccataatggcaagtagatatctggaatcccgctattaaatagcatcaacatctgaattcatgtgtttcaccgatttctcaggctattatagcaggagaaactcatgttgtaattttacttatcaggaatttgaaagccaaattagttaagtaaattaaagtaacgcagctagttaacagcagagtcaaaactagagctcaactatctcaatattgtgtttattagtataataaacgcatataaataaatgtaactatttaattaattgacaacaatatgaatagttacgtttgcacctgcacaggcaataataactaatgcacagctgtgacaccatcacctatgagacgtatctgttttcagaaatattaaaaacaaggtgcatccagtagggtgactatagttaatgacaatctattttgtatttcaaaatagctataataaaatacgtgaaatgttcccaacacaaagcaatggtaaatgtttgaggtgacggatacagaaatatccttatttgataattacacatggtatgcatgcatcaaaatatcacatgtatcccacaaatatgtacaattattatgtatcaatttaaaaatgcacatcttagttgcaataaaatacagcaaacacaggtgacttttcagggcctcgatttcgttcatgggaagaatgaaagatgacatgactctgatgactttttccatgccctatttccaggcaacagagtgtccttctaaaccagaagagttcagctctaacacagaagactattataaaagttagactcctttgagagcattggctgttctttatttttgtgtatatcctttcctttctcgatttcacaagcaactcctgacgattctaggaatttattgtccaattttaatttcctgatcatagttatagctttgaagttcattatcaaactttgacctcatgccctcattcctacctctcagacacaaattatattattacagggatatatattaatatttcaacatttctgcctttcctaaatccaaataaaacaatagaatactgaattaaattactacgataatttatcattgtttctaatattttcttgttttttttctgagaatgtggttattgaatagactacttttttgattatgcaaggctcaatgtcaacattttgttgctaaattataacattaagtaatccagatcacacaatatttttctttagctaagaaacatgtttaacttccagctacaacattttctcacagaataagaattacattgtttgtatttatctttagcttcagcacttattgcagttataaaatatgttaatatcatgggcataacaactgaaagcgtacttaattgttcaaccttggggaccacataatctacatcagatttctatgggtttttcatgtctctggttatgattgcacctttccaatttgtctctgtgcctcaactctctctctccccttatccatcctgtgtagcccttctaaaaagaatctttgaatatatacttttactcattttatgatcgcctgttcctccagctagcttctctttgacctcattgactcaattcaccttatgcctttcccctaatatcttgtgtctaatcatgtgagacttcttaatatttccagggcagaccgtcctcttttgtcctttcaaggttattcaagctgttgtccacacttctgatgttctccctctataatgacaagcttctactcagcctcccagatgagctaatctaccaccttctccgtgaagctgggtcttacgctctgttggagaagagactactctgattccttcacagattttactgtacctatcttgggatactataatgattttgatgctgttctacctgactaaacccagctgttactatttagcaatggatacaacatagtagatactcaacaaatgtcttttaattagtgcatgagcagcagtatctgcacagtgaaagccactgtctgtatatcctcacctcctactacattttaacctaccacaaatagttttttgatgcatgcttccagtgaaaatgtcttttatcaaggtcaagtatgagctccatattgcaaaacccaatggtctattcttttgtgtttgtctaattgtattttcaacatttgacactgtttttgattctatcatgaaggactttcttcatcccacttgcctggttttctctataaatcacagaagttgcttttgtctcctttgagtattttttttcttcctcctgttttgaaaggtgcagtcaattctcgggctcttttcccaaactctcctcctagaagacttcatccagtcccatgtctttaaaaaccatctaagggcctatgactgccacattatttatttatttattttgagacagggtctcactctgttgcccaggctggagtgcagcggtgtgatcacggctcactgcagccttgacttcccaggctcaagtgatccttcagcctcggcctcctgagtatctgggactacaggcatgtgccaccacacccgattaatttttgcgcgcgtgtgtgtgtgtagaggcgaggtctcgctgtgttacccaggctggtcttggactcctgggctcaagtaattctcctatcctggcctcccaaagtgctgggattataggagtgagccactgtgtccggccaactcttacgttattattccagtcacagtatctgtcttcagcttcagactgatctacccaactttctttccagcatttccacttggatatctaatgagactctgataataagagagactcttgatttcatcacaccttgtaccctaactttttcctcctccacttttccccagcaaagaacttagaaataattctcaattattctcatactttacatctaattcatcacagcaaatcctgtcagctttgtctttaaaatgtatcctaaataccagctctctaactgaccccaccactccaccctagtctgaaccacctctgatgtggactagtaacgtggcttcctgtgctatctccctgtattcactattgcttccatttcagtctaacctctactcagcaatgatgaatgaactctttgaagaaagcagatcaggtatctccactctatttttctaaattcttcaatgatgtcctgtcaaaattatgaaagagttaaattcttttatcacggcctgcaagatcccgtgtgatcttgcccttgcctatacttgcacctccttccttccccaccttctcttacactggaatccttgctatttgttggctaggtcaagtctcttttgaactcagtgcccttgcccttgtttcctctgcctggaatgtttttgcccaaattggagaatatctgctctcatatctgctcaaatactgccccctagagaagccatgccaatccacccaatctaaacaagtccaccttcaatatcattttctattcccttaaccagctttatttccaatatggatcactatctgaaatcatatgtgtatgcatataataaataatatcatttattctctagctcactactagagtgtaagttctacgagactagggacatacttatgtattcttgtatcccaagtacctggcatatatcatgtacttcacaaatatctgtggaataaatgaacacattgaagagatctacattatgccatcgtgatgtaaaaattgttttgagctaaagccatttgaggatcaacagatacgggaaggggctttttctgtactccccctatctgcctaaaagcaaagatttctgaaataattcaactgttttaaatcctcctttaaggaaagtttcttgcaccaggggtaaagagtgactcctgtcaccagagatgagaagttgtcgctgggaaaagaaaattacataaacagactttactaaaacaaacattacctttcattagtttctttcatatttcccaccaactttgtggcttgaaattctaacactcttcttttcaaaacccttgttaaaatagtacataagccccaaattctaacttcattgagctatgttttctgtgagctcccacatacttctctgaataaactttgtcttttctattgccaatctatctgtcgtcagtttaatttgcagccccccaagtaatgaacctaagaggggagtgaaaaagtttttcttccctgacaacacaaatggacacatcaataaatggatagcttgagtaaatttcctcatgtttctaagcctcactccattacatttttattgatcacagcaccagtgccagacgacaaatgggaattcttaagagaaagggcattagaagtgttaaaaggcaaccacagagagctgtcacatggagaaatggtccatgccatcttcatttgatctcactcctagttgggagtcatcagaatggggaacggagatatctttcagcaaggaggtcccagtgatatgattaataaaaatatgtcaaaagacacatgagaatagaagttcatttgatacaagcaaaggttattgtttattctactaatacggttccacagaatccaggtcccagcagtgccccctcttagaaggacaagcctccctagttttcaagtcttcacaaatgtggctagctgacaaaataccatctgatcaagtcataatcttctcagatccttcataaatcttcttactgccatgctcatgtttttaaccccttccaacctcttcgagctgacattaagtagcttcttttaaaaaccagcagaaggttcatgaatgcatatgggagaagagtgaattttaggtcaaattcccaggctatgatttaaccttgtcgcaatttgtactctcccaaatcagagaggaagcctgcctacagggcacttagaatctaagaaagtgccttcggtggagaaaatatttaaccaataggtttgtttgggggatggtttggatagggatcttctatatggacctagaaggattatcatcagagacaaagagtatgtgaactttctgttaatgcccagagatgtgacaaccagagaggctgggcagaacagaatctcagagggcatgtggagcaactgagaagactataaaggcattgtgttttcttacctcaagttcacgtaaggcttataactgtaaaatcatctatttttggattatccatgaaattctcaatcctaggctagcagttttctgcaacttacaagcccatgcctctcctacattcaaaggtttccaataacattacacccagggacaagaagtatattattttattggcctgtgaggtgggggaaggggacaaaatttatataataaagtatcctattttacacagtaaagtttattgctttactttattaaacactgatcactgatgatctgttctatagctttcccaaaaccctgtgtttctggattttcaattatgcagagaaaaaagtgaaatctcctgagctggcagctcttcccctccatcatagttcaaaaggtgacagggaatagcagcctacagagtgaacagaacataactctctgagccatggttaagctccagcaattttggtggtcgcagtaaacactgggctaaacccaaggaacttctccccctctatgtggctttggttatatattgataaccaaagctgatattgctttggttatcaaagcaatatcagcatgacctgggaacttattagaaaagtaaattctcaggtctcaccccacagctaccttatcagaactcctacgagtggggcacagcaatcagtattttaatgagtcacctggaaattttgatgcaggatcaaatgtgaaaaccatcgccctatagcagcaatccccaaccttttcggcaccagagactggtttagaggaagacaatttttccatggatcaggggcgggtggggttgtggggagaggtgcgtgggaggcgatggtttggggataaaactgttgcacctcagatcttcaggcattagattctcataaggagcacacaacctagatccctcgtgtggacagttcacaatagggttcgtgatcctatgagaatctaataccgctgctgagctgatagaaggtggagctcaagtggtaatgctggcggccctgcagctcacctcctgatgtggggccccggttcctaacaggtcactgacctgtactggtctgtggccccagggctggggacccttgctctatagtgttaaaagccaaaggaaagcgggcagatcacttgaggtcaggcgtttgagatcagtctgggcaacatggtgaaaccctgtctctactaaaaatgcaaaacttagcagggcctggtggcgccagagcacctgtaatcccagctacttgggaggctgtggcatgagaatcacctgaacctgggacgcggaggtttcagtgagcttagatcatcccagggcacttcacctggatgacagagtgagacagttaaaaaaaaaaaaaaaaaagccaaaaggattagagcacagaggattggcagtcttgagaactaacgtaaccctatttgcaaggtgacagtatgtatattgaactgtatcaggtccgcaatgcagcctttcgtataactaggctcctagtgcggttgtatgctaatcctagtcctaaaaccaagattaggcaaaaacagacttgagattcatttgagtcaaggtcccattactcagtaactcctgagatgaacacaatgcccatatataactaggatctccggtgtaccctcatcttctgatactgcctccttctcatttgccttgtccactgtgatgtggccctttctgtcttccatgtagatgcataaagccctataccaagcactgcaaacatatagctgagaaggtcctcagcctccagaaacttacttttgtcttaaccacatctgattgatgtttatctatgggtctttatgcgaactgtttcttctttctgaattacccttccctgctttcattcttcattttgggactgattccacagccctgggtggccatcacaccctgtggtcacccttttcagtgcacagtcttgcaattacttgattatacagctgacttgccacctcaactaggagctggttgaagggaggggctgtgtctttcatctctttatcaccagcatattgcacagttcctacctatagttgatagttgataacttttgatgaatgaatgaacgagaatcagacattaaattttcagaaggaaaaaacagtttatccttaaacaaatgtgtctggattcagaagaatcattttcccttcgactttatgctcacaaatgtgttgggattcagaagaattccaaccttttcatttgccttgtccatgttatatggtttcttatagcctagctaaagcagtggttttcacagcatgatcaaggccagcagcatcagcatcacctggtaacttgctagaaatgcaaattctggacctgcaccaaagttactggaccagcaactttgaaggctagcctagcaatctgtggtatagcaaaccctccagctgattctgacgtgagtactactggcctagagttgcttctaagactttggtataactaccagtcagaatctaggtcttcacacacagacactgattcagtaggtttgggatgaagggcaggcagtctacagcctttatcaagctgcccagatgatgctgaaaggtgttttatggattcagaagagtctcaacacattcgtgagcataaagttgaagggaaaaaatgtttaatgaatttgcctggggttttgttacttcttccactcctaacttcatttataatcaaggccctaagcagctggtttccacttaaccttaccaaactcatacaaattcagttgggattatttacaacttccagggttacttgcaattgtatactgagtctccaaggtggttaatgagccactttggatgataacaaccaccttggctgataactaaattgataggtaagcaatgtattataatagcaaccaaacccttgcttctctgatttactgacctgtcacagatatggaccaaaccaaatttctgaaattctggctgctcaaatcccaattgcaacctgattgaggcattattagtattggagtttgaagtaaataatacaaatgcatcgactgaaataggtagagaacaagcccggaagtgcaaacgttcgttagaagttactgatttgtgcagaactctgtgtggcttgggcagtcacttctctttgtcaagtaaacatacaaaacgtttgctccttccaattgcaatggtatccatggtagatacgtgcaatgcatttgaaaataataacttgagatcgaaagacaaaaaatgaatacgctaaggaagtgtggcagtcacaaagaggaatgtatctagttcttaatcagggcagacctcaatattcacatttttagcacaaaagccaaaagggagggttgaaatttacaagtcccttcatcttggttaggctctgtggggagttctccctgcagctggtgggctgcttcctgcttctgatgtctccacctgcaggtggtggcactggcccctgacctcctgaaataagcctgttgatcttctcccacattattcctgctgcctgtggactgctgacaggaagttaggggacgacaaaaagtccctcagtaaaagactcgattaagtggctaaataacgtttcctccgaaagctttcttttcaaataaggttttcaaaatatgtgtgcatatatatatatatatatatatatatatatatatatatatatatgtattcggttttattcagaatgcagaagtgtatctgcggagagcagaagggcattggaaggagtcaaaaaaaatgtgtgtgtgtgtgtgtgtatacacacactcactatatgccaaaaggaaaagcaaacaggagaaaaagatgtgttgaaatcttgacagagcacagacaacagtggcatatttgagttagaaaataaacaagggtgtgcattttagaattctcagatttatttgatttttgtccaaccactacaaagtaaggagtaaacgtgaatatgagggggtaagagaaaataagttgatttaatggtgaactagggacaaagtcctagtgttttgcatttgctctgtgacccaggtcttcagcacctttccttggcaagtcaggatgatttttaactagctcctaactagctttcttgtgttagttctgtttccttcgaatctataggccaagctgcagaagggggctttctaaaattcaggcctgtgaagtcattggccagtataaaagccttatatggtttttcctatagcgtagctaaagcagtggttttcaaagcacgatcaaggccagcagcatcagtatcacctggtaacttgctggaaatgcaaaatctggacctgcaccaaagttactggaccagcaactctgaaggctaacctagcaatctgtggtatagcaaaccctccagctgattctgatgtgagtattactggcctagagttgcttctaagactttggtataattaccagtcacaatctaggtcttcacacacagacactgattcaataggtttgggatgaagggtaggagtctacagcttttatcaagctgcccagatgattctgtaaggtgttatctggattgcatttagagaaatgctggccacagtctaaatagtatctgaaccactaaatacatctctctgtgccccctgcccaccccatctgtgaaattttttgagatcatcttgagctccccgtcacagcacagtgcctgcaacagaactgacacattcctctctaaatgtttctgaataaataaactgcactttggcagacaaattgcaatccctaatgtgaaccttttttctcttatctagacaaatgaggcaaaactactctgacagacttcagtggtagtttttaaattgttgttatttaaggaatacactactcataaggacttttcttctcacattgaacattacaagataaattaaaataattttatctaagtaaatgtcctgacactaagtttagccagacttcaccccttaatcggttttctaaaacacaaaaagaaaacaaatgacacctacatggaaattttacttttgaaaagcagtgaaagaaagcagtgaagacgctttgaccttgagtaagattacagcctctggtccccaaatgagacatgtgtagtcttaccttgtctcaggtaaatgtgtgttcatcttgtatacatacataccacatgaatacaggaaggggaatactaaaacctagtaaggtgaatggttttgtgagcatgcatatatatatatatatatatatatatatatatatatatataaatgatcaaaattgatgctaatgaaaaaaatctgtcttgttacaggatggacctttcttcccgtggttctttaacttgagtgtgcgttagaattgcctacagggcttgatcacagatctgcgggctccactctccaagaatttctgtttcagtaggtctgttgtgaggctcaagaatgggcatttctaaccatccccgtgatgctgatctgggacccacactttgaaaacaactgctctactccatagggggaaatgaatgtgtcaggaaaaaggtgctctgtttctgaagaaagagaaacatgaaaggttagacaaagaatataaaggtaactgaaatcctcgaagtaaaataaattccacctcttaactatacctataatcctttgtttcacaggccagcctaaatttaccactttatcttatagagttgtctgtgtgaatccgctttcttatgatatagtgagctcctttaaacattgtggcatgctttattcatctttatgtctgtcatagattagaagtagtaagtgttcaataaacatttgttgcgttaaaagtattagaaaggaaatagactgtacactttattctcgattggtagaaattttatggtgtaatcctaaggtaaggtacactattgatttcaatgtttgaattttttattttattttctatctaaaacaattcacatgtgtaatgaattaaacatctgtcttttgtgaggtgatacttaaaaaatacttagagacacttaaataaggagcataatgctgtagaaataccatatatggaatctattcaatttaacaaaactttatattgagcttctaccacatgcctgatagtatactcaatgctggaaatatctaatataatgatgttaagagcttcaatttattgattagttagcatacaacaggcaatctgcaaggtgtttacagcaaattatgcttatttactcatcgcaatacctctacgaagttggctttattagcatctccagattaaggaagaggaaatcaaagctttaaaacattaatttattctaaatcacacagctaagaaatgacggaaccatgattcggaccaacgttgtccgaagctagagtctgctttcaacagctctgctgtattgactcattccgaagacagggttagcccttaggaaagccacatgcaaaagagacccaattactttctactgtttaaacctgagcgaaactagggttacgtttacctaggtccaaagtcctaatagaccccaaaggggagctcttttttggatacatgtcaggaacatgttaaggtacaacttttcattcatcaattcaataaatttctcttgaatatttgttgtgtacaattactgtggttctatgaattcagtggtgagtaagtaaagaatgcccaatatctagtgggtgacacagataataatcaaatcctcacacaaataacatgtaattacaaactgaattaaggatgaggagaggaaaataaagagcactaggacagcatgcagcaagaggacttaattcaatttgtggagggggtgaccagggaaaccttcctgagcaagtgacaaccgatcaagaccggtaagacgggcaggaaaacgtgagtgtgtggagtgggtggagacagtgagcagattccctgacaaacggaatagtacgtgcaaaggaaaaagagattacagcactgtagttagagaaatctaaaaaaaaaaaaaaacaaagttagtgtagttggagtacagagaatgagcagatgagagggatagtaaaaaatactgccaacatagcaaaggacagactatgcaaagctttgcacaccattttaaggctaaaattaatgtgaaccttttgaaggagaaatctagccaaggctagatttatatttattaaatatcacactatctgtaggcagaacagtctggtgggtaggggggttactgtgttaattccaatgagagacgatggtagcttgcactaggatactaatgggcataaagaaaaactgtagagatattgagaaggttaaatcagtaggaccaggtgacagatttaataatggtagttgacggacagtgaggaagagtgaggaaaaaaaatccagacttttggcttgcttaactggatagtgtcattcactgggatggaggaacctggatgtgtatcgggtttgaaggacaaggtcgaacattcagtttggtccttgttgagtctgagttgcctctgatacatttaagtggagatgtcaattaggcaggggggtatgtatataagactagcattcaaatgagagtttcagggctggagatgtaaatattagaagctttgcagaaacattagttaggttaaatcaggaacatagataagattacctagggacagaagacaaagtgaagaaatgaaaggagatatcattccttctttggaaccttgtgtagtgaatcagaatcaaaccctgtttaattttaaattacaaagccaatctaaccactcactgtgtagatgaagagaactgaagtcctgcgagttttatccatttgctagattgtaaaagtcaagctggggcaagaactcaggtcttctgagctgcagtttaattctccacctttatcgatatttcttaaaatgtggtcctggaaccagcagcatcagcatcacttatacacttaaaaatgcaaatatttaggccccatcccagatctactgaatcagaagctctatggctagggctcagatgcatattcaggtcagagggctcctgctctattttgtgtaatccccttcctgagtgttagcaaagtgatgggttcacacttacgggtagagaggtagcaggaggaaagtgaagctgttcttgactctgtgccagaagagattacagaaactgaccctctcgaactcaacagaagctgtagaccacattggtacatgtgttttataaactacaatcatgcatgccgtttctgtgctttgcaaaagagacagatagtggtgccaggggaaaggacattagcagtccaagttgattaggtaaaatggtctgacacagtgaggcaaaagttgatttggtaaaaacttgacatagacggcactttcaaccatcggtatccacttaatagatgtaaacagctattttcacgacacaaacacccacacttacatctttagaacagtctcagcaattctgtatgcttgccagataaatctctgctgcaaattatcctccagccatgagatttaaaaccaagagtttctagtgttttgttcctttgaaatatgtaaccttaaccagatgtttataccctgggtcacaaaaatctaattgaatagttcacttgatgtgttcgcacaattaagaaactcttcttccttaataggggaagaggggcaaattcatatgtttaattttcaaaaacacagagcgttctctgctctacaacagtctatcagctagaaatgtctattaactgtctcttctctacttcatgagcacaaagataagttgtggttttagggaccctttgggggatattaagagatcttgaggtaaatgctaaaccaaacagtttagtttgtattcaggacagtagacacgttttatatactatcatcctactttaacattaattatattaaaaaattcttcttttaactgggctatctaattaataaggccagcaacattccttgaccaatatgcttgtataagcttagtttatttttgtgtataggatttatatattcaattgtactgatgaaaaaagtatcaggagcttctgatcttcctttgtgacagtgagaaatacagaactctcagcacttaacaactctgtccaaacccttgcactaagacttgactaaactctagtatggtttctagccccagaaggccatgtccctaggatgaccctagccttcccttaagtgcctgcttgagaaagctcagtgctgccaggaaaatttaatgtttgttctagccaacacacatctgttgataggactcttacctccgtttcttagaacatttactcaaaagggcttacaattgtgaacatgtagctcttggaaatcagaagtgtctctcactcaaggacctgaaagccattcttttcaaatgacatcatcaagaaggataagtcctctgtctcctgttctctgtgggaagatagaatcctaacttcaataacttccagctaacacagctggcctaatcacatttacactgtccagccctttgtacttttttacttctctaactcgaatgaacccccactccttctccctccttcttgccttaaaacaaccaagtcgcctctgcacaaattagaatggatctcagctctcccctaatttcacgaggtattgaataaaatctgtttttacctctttaatatccagctgtgtttatctctgacaatatatatgctctcaaaagcattccgataaataaattttcctcaatgatcaagcataataaaatacatcagctttgttaaatcacctaaatactcaaacaactctaccattagtatgtgaggtagctttgaaagtatttctaatttttctttctctttaatatgccacaggaagggacgaggcatttatttgaaccttcaattatatgctatcatagtaagaagatgattggaccataaatgcaaagacatgtatttgcaattgcattgctcaagaatgccagttatgtccattatccatcccttcaatgaaacaaagaccatccattttcttttagaggtaatcactactgtccaatgcaagacacagaaaataggcaatttggaagtatagtaactagttagcaatattcttttaactttctatataggtatactttttacatgcattaatttcactgtaaaacaagtaaaattatatgattaaaaagaaaaccagcttctaagattttgagaatgcattgcatacaatggtcaatgttaatctagtcaacaaagaactgttcaataaaacatgtttgtttacaaaatcagtggaagacttcctcagaaatattttatgtaacaaatgcctagggtgggctgaagagaaaaatccagtaaaatggcatttcaaaatttatattttcctttacatgcctctaatttaaaataaatatctgatatttttcatagatttagtttgtagtacaaaatcatgaattaaatcctaatgatttgaactataatttaaaaaattatattccaaatagcaagccaatcgattgacatttacaatcttctgataaatgcaaagtaccaattccctaaacatagcgttttatggtgactttttcaaaataactacatcattcaaaactattgagttgcctgtaaaacctaaattgcttgaacattagttctggagaaattttcatgatgcctttaaactctcagtgtcaaattcaacatttaggctttaaagcctatgggtggtatttatcaccattcaacactcgcatttatcacataaggaaaatatgtttaagaaagcaaaactgaaataggaactcagggtttaaaacacttctacttataacctgtgtcgttcctctttgtgtaaagtctatgacctgctgtttggaaagacaccagatatggagaagattttgaaatgcccaaatctttataacaaagcatcgaacagaggatctgaaagaaagagcacaacagaaactcaatgaaatatctagcttatcagtctgacaattaatcatatctaaggccccacctctaatctcagtaccttagccaaaaattaaataccaaggacagttacagtttgctctagatacctagaggaaagagaacctccttttcctcatcttttccatactaaaaatgtatactgtatctttcagattaatatatcagctaaaattttgttacttcaataaaccatttttgcagcataactcttgactgcaaataaaagtatatatactgacaatcctcaaattttgtttttcagctttgcttcatcagattactagaatgaggcagtgtcatgcattgattcaataaaatttccaaagtcacctaataaaagtacattttatgatgagaaaacaacaccaaaaaatagttaccaatgcttgatacctcttgagatgtggacctcttagaggccaatttgacagtcagaagagtatgagtaatgtttttcaaaagtttcatgagtacaaaattaaaatcctacaatgtaataccagcttctcttcctacttaaaggagatcataacgattgaatcaggattacattcaaataagccaatgacaaatgtgaaatgaaagagttattctcaccaataatcattgcatcctaaaagccaaagaaaaactgctataagggacttctcaatcagtccctatagataggaattggtagttcctacagaaaaaatatatatacatctatatatatatagatatggagagagagagagagagggagggagagagagagagagagagagagagagaaaattggtaattctacagaaaacattatgtccaagattttttccttggcttctgatttcgaggccaacgagtttgggtcattttaaagggcagacatcagcaagtgcctgcagtgacaaatagttattagctgcaacacaatactttttatttccaaaggttggccagattgaccaaaggagaatcttttcttctatccttcctttctcatttttcaaagactttttttttttttttttggtcccagaaacctttaagtctttttaagctggcttttttcccccttacgctttagctttgctcttttctttgaggtctcagtgacatataggtcagggacgtctttaccaatgtaatattagtggagagttataacaagggggtgaggacactgaaggcttacacaggtgcctgaataatttgccttatcactccacactggtgcaagtggtgcagaaataagagcagattatggcttttgctacatatacttttggatttacagatcaagtgtaggttttcagaaagtttgagtgttacacacaattattaccaccatacccactactatcaatgccagaattatcaatggataaaatttgtttttattattttctattgacactgagttttatatatatatatatgtgaaatcttgtttctgtataaattcccataatgcacactccatccaagaacaaacataatttaactatagatcatatcacataactcctctggttaaaaaccccaatggcttaacatttaatttataaacaaaaaaagcccaactctttacaacgtcccggaagactgcacatcatctgatgcatgccagatctctcccttcatctcctggcacttacctctccatcaccaaaatccactcacacttttcctcaagtaggctaagttgactatgcaattgcacgctttttgtttcctttgtctggaacatattctttaggtatctgcctctgtcactattcaggttccttttcaaatgtcatttcctcaaacaaaagtccttctctggcttctctgtctggtgttatgtctcaactcacattccagttacactctaccacactgctcacttttctgtataagacatattgatatttaaaaattgttattactttttaatgccaggtgcgctggctcatgcccgtaatcccagcactttgggaggccgtggagggcagatcacctgaggtcaggagctcgagaacagcctggccaatatggtgaaaccccatctctactaaaaatacaaaaattagccaggcatggtggcgcatgcctgtaatcccagctactcggtaggctgaggcaggagaatcatttgaacccgggaggcagaggttgcagtgagcagagactgtgccactgcactccagcctgggtgacagagtgagactctgtctcaacaaaataaaataaaataaaatgaaacaaaaattgttattttttaacatctatttcattagcatataagatccttgagagtaagaactttttgcttctgattcattcctgtaattcagcacctagaaaaacatttggcatatagaagataatcaatggataggtgattgaacaaacagctctttgaaacaggtacgagttttcttgttatcttaaggataaaaaattcctgaagtttagaaggggtaagtgacaggttctagatcacatagcatccagcagagccaaccattgaaagtaagactacatgcctgtctagccaaataaaatgaatttggacacattgtgatggagctagggattgtcaagatcatgtatagacatcctaacattcttgtcgcattggaaaacgcagatattatcatgtattatgagaataatttcttagtcagggatggtcattagtgatgaagaaaaaaccctttaaaactaagataacttcaagaaaatgggtcatttaatcctctgttctactgctgctgttttacacgacattctcctctaggtattacgtattcagtggaaaatatttagtgcttgtaataaagtaagccaatggccatattgtgaagtatagtgctctacactggatgtcagaagacctcagtgccagaccctgcttcttcacacagtagttggagggtaaagtcatctgagactgtcagttccgtaattttaaaatggaaaaagcatatctgtcatatcaacctcaagggactgagagatcaatggagatgatggctataaaagcacattttaaatgccagagggatataaaaatggaaggtcccatcattgttatttagggatgaaggctttttaatctatatgtgttcagtaacatatattgcatgagaaaataggtgaatgatgaatattataaaataatacaaaaatacaatattaatagatataatgcttacctataaggtcaatttgttttgacctaaatttagattaggcaacatgttgcataaatgggtgggtcagtaacggaaatgtcactctaaaaaatgtgcaaggaagcaactgtccatcatggtcaaattacttcagatgccttgaattcatgaataaaacactccatcaaattttatgcatctcaagcacttctcacacatttaaatccacaacatcctagtgaggtagggaaggaggaatatttcatttttcttatttggtgaaatgaggataatgaggcacaaggaggttaatgatagatttgaagtgaatgcaatcagtcagcagcaaaaccatggttggaatttaggttccctgaattccacttagggttcttttcgagatactacgttaactacatttcattgttggaggaatttaattcagtcatgtagatacagatgctcacaacatcttttttcatcctactaaggaatcttgctgctaattcaaccactgagacaaataatacgtggacctgcgctggagatttggcttcggtgttcattcaagtcatttcctgagctaacttctgttccttttcctatgaatactatattttttcacattataccactgaattattcagattcattgaatacccttagagttattaacatgttatatctaaaaaaattactgctttctccttttggttatatagctagaaagtcaggatatagtaaaaggagacccaaaatgtaggttttgaaaatagaacgtcagtttttgaggacaccacacacttttgtttttcttcccatctcattgatcactccttttcttttcttttttttttttttttttttttttttttttttagatgaagtctcgctccatcgcccaggttggagcgcagtggcacaatcttttggctcactgcaacctctgtctcctaggtacaagcaattcttctgcctcagcctccagagcagctgggactacaggtgtgtgccaccacacccagctaattttgtatttttagtagagatggggtttcaccatgttggccaggctggtctccaactcctgacctcgtgatctgcccgcctcggcctcccaaagtactaggattacaggtgtgagccaccatgcctggctgatcattccttttcattatcctgtgctgttttctcctttgtcaatccacctcttaatgttagagtccttagtcacgttgtcatttctatctatattcttccttagtgatacaatctgatatcacagctttaaatgttatcttatacaaacacctccgaaatttaaacgtccaacctggaccttttttgctgaactctaaaggtatttattcaattgcctattcaatatatctggtgatatgtctaacagatatccaaatttaatgcctccctaatcgccccattctatctatagtctttattatttcagtttagggcaactttatcccttccagttaatcagagcaaaaacgttggagccattcatgactccatttttctcccatgccccttatccaattcatccagaaatccttgttggccccacttccaaacacgttcagaatatgactatttcttatcaccctggtctcagtcagcatcatcttctcacacttagaaagagaaaaacgtccttacaatggcttcaaaggtccaccctcacctcactaacattctctcctaaacctctctcacttacttcactctagccacactgcagataaccagccccaaacagcagataaaccgatggcttaggaattctgcattgactgtttactgaacccaaaatgagtttactgctgatatctacatgattcaaccccatgcctcattctttgagatctttgctcaaatgtcaccttctcaatgaagaataccatgataccctatttaaaattggaatgtactccagcatgagccatctcttattttacccttcttcttttttttcacagcacttatcacttttgaacatactatacaatatacttatcgtatctgtctttcactatttgagacccccaagaatccagagggcatacatcttttctgctttgttcactgacacattcaaaacatctacagtagtggctgacatatggtggtggctcaataagtatttttcaaattaacctgatgctaagtccagaactttcaactgcccagtcacagagctagcttcagggcatttaaagaactgaacaaacagataatggaagtgggttcatgtagatagagaagaaattaaaagaattctcattctcatgtagaatgagaagacaatggggaatagggatacacatgtcctttttttttctactgcaggcaaggcacagaagcggggatgtaaacaaaggagacatccgtgaagatgctaatataggttttcacaattctaaaaaaaagataaaataaactatgtgtttaacggtgacatggttttaaagagttgctgaatgatcagtctccctttccttttctttcttccagcgctatattatttcaaagggtcactggttacttcatgggaaccagacgttgttattgccacttgtataagtcagatgaataaagagaaattcttgataaatgaggtatactttgaaggcaaaatgttcagaaaatagggtatatgtgagatgaaaaagtatcctcagagatgaaaggatttgccaaaaactgatataaattccatgggtgcaaacagagttctaagcctactgcaataagatttgactttattggattatctatgaaatatattattgtagtaggggtctatttttatggccacatctggtctagacttcacaaaagaattacaatgggaatatactctaccaagatgccaaaaaacacatatctcttcattcctgaaagatattgcctagactgtctaaatctgaaaattaacaaggattctgtaattacttcattttcatctacatttccccaaactaaaaggtatcctagattatttgagctatagatgtgtttttatgtacagctttttaaattaatagtccactagctctatcggttacagcagtaataaaaaaacttttatggaaagttctctgagactaaaagtgatttacatgcaaatatatggaaatgattcccttcttaaaacagtaacaaaaggtgtgtttgaaaattcatgctttggaagaataaatgattttcacataatcattctagtaagttgtttatttttattgacatgcatcttttattagctatttaatggtggttcacaggggtgagtgcactggatcacgcctgtaatctcggcattttgggaggccaaggtgggcagattgcttgagctcaggagtttgagaccagatggtgaaacaccatctctaaaaaaaaatacaaaaaattagctgggcatggtggcgtgcgccagtagcctcagctacccgggaggctgaggtgggaggatcacctgagcctggatggttgaggcagtgagccatgaatgcaccactgcactcaagcctgggcagcagagcaagactttgtctcaaaaaaatgtgatccacaaaaaacaaatttaagttgttgaatattttaggctagctcaaatacttaactttaattttctattaaaatatataccttatttaatgctaatggtatctaatttgcagctatcgttactatacacataaactgcacaaatcaaaataaatagaaaacaaatattaataaaatttagtcattaacccttctggatgacatgttataattaggatattaattggaattggcattataaaaccatttagaattcgttgtattaaaaaaatctgattccataaatcatggggaattttttattttaatgacccatgtattagacttacagaaaattgtggaccttaagtaatgttttattaaaatgttctgctatttaatttgtcatatttaaaaatagctaaaatcatagttttaattttagtaatatttttcattgtgttctaagtaagccaacccttaaacatcaaatgctttcttttgggatatgtcttttcaacttctggttccctcaggtttgatccattgacattctaggcactgttggtgtgtcccacctagtatataccagccaggccttctttatcatgccccctgggcaaagaaaaactgattccatttatactagaataatatcattgttgtcactacttattacctaggcaattggtcacactctactcccttcttatggtactttcattaaggcatatgttcctttatgaaaaacattccattcctggcagccgaagtcaatctacaaatagccaggtagcaaatcaatgcagattacaagagaaagtgaacaagcaacagagattaaacaaaacaaaacaaaacaaaacaaaacaaaacaaaacaaaacaaatgttagagattgtgacttgaacgtggcacagcctagttccttgttctgccttgtccttcaaaaaacagggtcattattttgtgagattcaaactggttttgaaaattaatcatctcatggtatacaaattctaatccaccgatggatgaagtagaactttccatgtttcttccactgccacttagaaaataatattgggaattgaacaatgagaacacatggacacaggaaggggaatatcacactctggggactgctgtggggtggggggaagggggagggatagcattgggagatttaccttaagctagatgacgagttagtgggtgcagcgcaccagcatggcacatgtatacatatgtaactaacctgcacattgtgcacatgtgccctaaaacttaaagtataataataaatttaaaaaaaagaaaataatattttattatgtacagcgtgcattatcagcacagataacataaaactttttttaaaaatgtgggtttattctagatttttaaatctatgaggcttatttagaatgctgaattaaactatacaagttaatcttgaagaaccagatattggaattgctgctctcattaattcctcccacctgatttgtgtatgccatcgccagcaaaccacatagttggtgcctcctttacaaaaaaaagttgtgctaggagacaagcataaattacaaggtcagaggaataccttcaagaatcttaaacccatttgaacagtatagaaacctagggatggaaaaaactctaatagaagaaaactacaagaaccaaaggggtaagccagtacaacctctgcaaaggtaatcttactccatccactaaacatagcattatatgtttagtcactcacacacaaagatagtgaatgactgataaggagaacctggccaggcattaacaggggatggcctttcattgagtaaaagatattccttccagagtagagctggtaaagccgaagagaactgtattcaaatgaaagtatagttttttttttcaactttaattttggactagggagtacctatgcaggattgttacatgggtatgttgcatgatgaaaagcaaagtttttgatttcaggtttttggagaaacaagagtgcctcggagctgtccatggtgctgcatgagaccaggccttcattctgcagaattcctgcctcttgaaaattctctaggccctgacttacaaccctgtttgctgtatggttaacctgccaaccctgctatgtcccctataagtgattatttaacataatctataatttcagtactaaatatttcatgactaattataacagctctctatgtttccctgggtgatatcaccacacattccaatttggcagatctcggtgggcccaggaatttgtatgcaaatatacatcctcatataattcttatgagggactaaagtcctgcttagactctagtcttcccaaggtcgcccaccttaatcccgagccaactcgtccccagttggagacaagagcagaaattttgattccacaaagctgtttgattaggcctcacatacatcatctggaatcacacaactgaagcttcatttatgacactgctacagtgtaccaattcctttccctatatattttttctttttttcaaatcctatttatcctacttcaaatctctatagcaccatatttagagtcattcagatcttgatttgaatcaataactacattgaaacaactcacttaaccctatattcaagccttcatgaattcacctgtcaaatgaaaaaaataacacctacagctttgcagaattattttcagggtaatatgagacatggtttctaactcagctagcacattatctgatacacagttgctctacttgcatgtgagttctgttccctttccttctctaaatcttttttaaattcttgcatcatttattactttatttcatctaatgaactcttgtttctatcatttgtctcatcaactagctttccagatccttgactaataaagatagatattgcatactaagtgtgtggtggatggttgccaagacctgcacagagcactttacatatcttggccatgaggactcaaatattgagaggcagagttggaattctgaatctcaagctacagctcctgtcatgccatactacagtctattaccattccatttcctccaactgtgcctaagctaagtgcctggtatgtggattaactgctatcagagtcttttttactgtaatggagtagatgcattgtctatatcctatttgctgcatccacataattatcagtccgttcaaaaagcatagccaattgctctatcacttagtaaacgactaacttagaccactggacggaactttttttggaaaccaaaagaaaacagctcctaaattgctgtacctgctctcctcagattattatgtgctggaaaatcggagacgattattcattctcatacacttcacattttccagaatggaaaattaagtagcaaaggcagatgtcccctgttggggcaacgattgagctggatatagaagactcatatcctgtttgctaaactgggctgttcttactattctcaacatgttcacatcatcataataaaacaagcgccccttaagacaccataaatattacaatctcagtcaatatatttatagagtcaggaagagttggatattctcatattcatcaactgtaattcatcaggattattatagttagggagggaaacccaaagttatgacactgaaagacatgatcagtgagttttaataactcaaaacatacttgctatataacacaggaatggcttttgacacatttgtcattactttataaaaataatcctttaagttactttgtggtgatgaaacacttctttatcttgatagtggtagtaactatataaatctatagacatggttaatgtcatagaataacagataatgactcacagtaaaagagcatgtgcaaaaacaggtgaaatccaagtaaggtctacagtctagttgattgcactgtgccaatgtcagtttattgggtttggtaatatactgtatttggttaatatgtaactggggaaagttgggttatgtatacacaggaaatctctgtactgtttttgcaactccttgtgagtctatgaatatttcacaataaaaaaatcttaaaacattcttaaaactttatagaaattttgcctgccttcaaagagactgtaagggaaaatagagaaagaagagagaaaattaaaatgtctggctaattcctaataggaagttttctttatttttatacaagaaacggaaaacatagttgctatatcaacaggattttagtctattttcttcacaaagctgaagaaggtgtgaatgacttttctctgtgcaagtgaataatatactaaaattacttgttccacccttgtttttgtcttgtttacatcctacttccataaacctgccaatatttagtcactaatcttaagctatgacagaatttaaaacagattcaatgatatgatttgaattcaccttatgtaagatattgtaaagcaatatgatgccacaacacacatctagaaaactgtgtcttctctcaaatggaactgagttgttcctaagatgtttaactaaagtgattaaatgggctgaattataacatattgatttttaaatggtctagccacatttgcattgttaattttttacaagattgcaccatagatataaatcactgacaaaatattttaaaagtagcatacaaaaatcgtcaacactgggataaaatttaactttcaaaattaaaataatcttagaaaattcagttatccaaaggcattaagcaatgacttttcaaagttgataaggatatagtttctattgtgaaagtctattagacaagtacttttcaaaattatataggttattgtattagtccgttttcatgctgtgataaagacatacttgagactgggaagaaaaagtagtttaattgaacttatagttccacatgactggggaggcctcagaatcatggtgggaggtgaaaggcacttcttacatggaagcagaagagaaaatgtggagacgcaagagcagaaacccctgataaaaccaacagatctcgtgagacttattcagtaccatgagaacagtatgggggaaaccgcccccatgattcaaatgacctcccactggatccctcccacaacaagtaggaattatgggagtagaattcaagatgagatttgggtggggacacagccaaaccatatcagttattgaaggaaaaatggaagcaaggcattttcaccaccaaattttgctcaaacaaggcagatataacctgcagctgcagaacaattaggtttatgtttttgagaagtttatagttaaaaacatttgatacattgctctgcatggtacataggagttttggtcacctcattgttaagcccattactccctatgcagtaacatttaatatttttaaatgaataaaaataaggtcaggtgcagtggatcacacctataatcccaacactttgggaggctgagtcgggtggatgacttgaggctaggagttcgagaccagcctggccaacatggtgaaaccccgtctctactaaaaatacaaaaaaaaaaaacaaatagcctggcgtggttgtgggcgcctctaatcccagctgcttgggaggccgaggcacaagaatcacttgaacccgggaggtggaggttgcagtgagccgagatcataccactgcacttcagcctgggtgacagagcgagactccgtctcaaaacaaaaacaaaaacaaaaacaaaaacaaaaacaaaaacaaaacacgttaattctcttctaaatggcctcagtgtgctctctttactcaatggcaattagtatgcacaaccccaaacctgcaatttttattctcctttgctctctgtgcctcctaaaacatcttattcctatttttaaagaactatttttaaaattttatttataagaaaaaatccagaattcaatataatatagagtgcaacacacacacacacacacacacacacacacacacacacacacacacgatcttgcatggtttctcaaataatagacactcatgtagaaagccttaattttaatttaaaaattaacactctggaagttacacaagaaatgatgggccttggggccttttgtgaaaatggcaagataacaaggcaggacaagagagatggagataacagacacaatgaatatgtatcagatttcgttgatacgttcattcttttttctacaaatagacattgagggctcactatatcccttgcgctgctacacacgggggatatgctgatgcaaacactggcaacataccttccttcatggtgcttacatcataattgcagactcagacaaaaacaaggcaggaaacagaaacaaggagctgagctatagaataatgttagaggatggtgcaaggggggtagacagccctctccaggactctccttggagaggattacctacccaaagccctgaggctatatagaagacacgattgcagaggaggatgtctactccagagagacactctgcaaattgtattaaaacttcccacatcaagggggatttgctgactctccttttgtttgaatattgtcagaagactacataggaaatggtccatccttcctcaccaacctttacggcccttccatcctctgagaaaaagagaggttttgacaaagggctttaaagtttcattgttttacttgcacttgctgagtccccttggggattttatctacactatccatctcacagaaaagtcgagagcattaagcaaagtaacggttaagaatatgcactgaatatcatcccttcttcattaacacaggacattataattttaaaacatctgactaagtccatgataatatggaaccattcctatccttctctgcacaaaggaggagaaatatctgtacagtctttgaacttagttagatatgggtctgaatttcagatattttactccatgctacgaccttgcaaagcttacctaaattctgaaccccaataaactcatggatacattaaagtaaaagctctgtgcatgcttgttagaatagcacactatacatttaccaaatggcaaagtgcctggcatggagaatgatagttatagtcataaacactagcatcgtcataattgaagaaattactgtccatgggatctagtcaatcattgagtattcactcagcattcaagactgatattttatctgaattccacaaatcacccttcactcaacacggttttcttatcatcatccttcaggtagagcccctccatcctatctctggatttgcatacactgtttggaatatctttaccattttcttttcatcagatatcgacaacttttataggtctactagatcatgaaatcaagggttatgttcatgtattacttggtttttgttctgtcctcagcacccaccacaaggccctgtatttttaaaggagctcaatataaatatattgaatggaattaaatgccattgctaaagttttcctcctcatgttaatctttacccgtgtaaaagaaactatcctttacctagttacacaacttcataataatttattactctgaattttcacaagaacttttgacttaaccactcatttaaaaaaaatctgcagataatcctgtaatatatttctccagcacagttcaccctcatgaagcaggcagtattgagcaagaggctaggctcactggttagacaagtaattgacccctcacattaaatccatgcaatctaaataatgaacactaattgtatgctgtaggctgccagggtctctcgctgtagttaaaagtaaaaatacattttttttttttttctttttgagatggagtctccctctgtcgcccaggctggagtgcagtggcctgacctctgctcactgcaagctccgcctcccgggttcacgccattctcctgccttaacctcccgagtagctgggaccacaggcgcccgccaccacgcatggctaatttttttttttttgtattttttagtagagacgaggtttcaccgtgttagccaggatggtctcggtctcctgacctcgtgatccgcccgcctcggcctcccaaagtgctgggattacaggcgtgagccaccgtgcccggccacaaatacatctttatatgtttactgtctactagatactgaagactgtcattcactaactggtcactgtgtataactaaatccttgtatttcaatgtgattatgaggcccaagaaaatatgtttcgttctgggtacctaataaactcttaagacttgcccatctcccacaaactgtaggcaaataattcttctaatctgcttttatttctttattaagataaagcatttgaggtcacaatgttctatggaaatctagaaattcctaaggcaaaatctaggtgacacaattatagaagatgccgcaactgatttccctcaagcacatttctgttgccatagaatcatctcaaatctgccaactttgaagctgaactcctctccattccactcatatggattctcacatgggttttagtagaaaaatttaaactattagaacatggactgatttttctctggattattaaatgagaagggtctggattccccattacttttctaattaaaatagtatcaaaagcaaagacaaaccaatcctcagcatgtatattacagagaacctgttacagagacattatcaaggccatatttttggtaaaattacttaaaatctgattgaataaaagttgcctctaattcgtttatattaatagcactttaaagtaatacatacggatacaactttaaaaagttgggatttatcttattattatgtcctgttaaaatacgcttataaggaagaccaaaaagagtacactgatgaggatctttgagaaaattaaaaatgaaaacaataataaataaaattgtcatggctaaaaagcatatttagtcttcatgatgttaaactattatgcaattaggcaaggacattcttgtctttcaaaaataaaattcacgggctgggcgcggtggctcacgtctggaattccagtgctttgggaagctgaggagggtggatcacctgaggtcaggagttcgagaccagcctggccaacatggtgaacccctgtctctactaaaaatacaaaaaattagccaggcgtggtggtgcacatctgtaatcccagctactagggaggctgaggcaggagaatcgcttgaacctgggtggtagaggttgtggtgagccgagatcgcaccattgcaccccagcctgggcaacaagagtgaaacaccgtctcaatgaatcagtcaatcaatcaatcaaattcacactttgaaatctattttttgaaagtatataatcataaatgaaaaccaaacaaaaccctcactggctaaaacaacatgatggaaacataaaagtgacaaagtttaagacccatgacacatgtatgtaagttatttcaaaagagatcactgttagaaatttgctggaagtgtttttgttactgtgaataataacacaatttttgtaatttgcaatacatcatagataaggcatatacacacataaacattgtgaatagtggtaacacattcagttattggggctttcactataatatgcctgggtgtgcctccaacggatgctaaatttagtgcatttgaagtctcttggaaaaaaacagtcccaaggagtttgaaagggaaggtgttttaagttcagcacagcatgctccttgcagcagcaaatgtgtctgaaagcttcttgctctgttgcactgtgagagaactatattaaaatgtgttaatagtagaaagaataagttcacctcaaatactatatttccttgatttttgagacaacagtgatttcctgtatgttaaaaattatagagagcaaaatacagccatttcacgctaatttattatctccatgtgaatgtgcatttacattttagataatatatagattacttgtgaattataagccttaaaatgaattcaaacatgtcagtaggaagaagctaccatattacagattcttgaaaatcacaaattgaaattacctaatgatatgattataatttaatactagtatcaaaggtatttttcctattattttattttactaattactgtaaactatcggtaggattataggagcaagacgtcaagatatttattaaccatactaattttttattggaagccatattaaatttaacctgtaaaatgagaaaaataaaaatagtaacctcatagattgtggtaagagtcaaatgaaataacttacatgaaattgctttgtaagttttatagggctgccatgttttgattgtatgatactatgtatccctactgtttaggacatctcttcctgtttaggacatctctttcatatgtgcagagacctgtgtttactgctttttttattcacaatgtggtcttttgttaccataagttaatgaaaacatttttcagtcttgtaatttataaaatgttagtgttattaacaactatacatagatgatagagatagatagatgatagataaaccgatccatcgatagatagataagtaaaggagagtgacagagacagggagagggagagggaaagggaaagggatggtgggagagagagaagtaactgagtggatggatgggtagatgaataagtggatggatggatggaaggagacaggtagacagccagatgggtatatatggatagatagcgtatgatctttgtcctattatttaacttcccttgcttcaattttagaagatataaaataggataacaagagtacctatcttataggattgctatgagcattaaggtagttaagcctgacacatactaagagctcagcaagtgttaagtatttttcactgtagttggtatttggctcttaaagaatctgtcacatatttctatacagtttttaaattcatagattagatgtagcctaataatgagagcaatcatccattaagcaccctctatgtgtctaaacgcagatgttttacataccgtaagtcatataacatgagaataaacctttaagacacttactgctctccccattttacagatgagacaaccaagacttaaagtattgcccaaggtcttagagttggtaacttgcaaaggcaagaacaatgaccacaaaaccagaacaactgacagcagagtatctgttccagctccaataattactggctacatcagttctgtgggtcccttcatgatggtacctatacctctagagtttaaaaataaattatcgtttaatttttgcataaactctatgatgtaagtcaataataattcctcttctttcttaactcactagcatactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtatccttgagtcttactgtttgggtctgaattcccattttgccattttctaactgtatacactcaaaaaaatttcttcttttttttttttttttttgagatggagtctcgctctgtcacccaggctggagtgcagtggcgcgatctcggctcactgcaacctccacctcccgggttcacgccattctcctgcctcagcctcccgagtagctgggactacaggcacccactaccacgccaggctaattttttatatttttagtagagacggggtttcaccgtgttcgccaggatggtctcgatctcctgacctcgtgatcagcccgcctcggcctcccaaagtgctgggattacaggcgtgagccaccgcacccggccaaaaaatttcttatttatacctctacttcctcatttctcatatagaagtaatagtgccatctaccttactatttagaagactcaattaatccatgtaagttacttagacctgtcattttagatattattatgactacatcagaagatattatgttagtaataagaaaaacattgttaaagaatttgaaaataaggagaataagatttgttaaggtattttgaaaattaattttaaattgttgttttgttagttagtagggtcttaaaatccttcatatcacctccaataagcttctgagaaataaataaatataagactctacatatcccatttcagggatgacttacagagggacttaataaaaatgcagaataaactattgtttttgttttgttttgttttaccagaatatctcccctttgattaaaaaaaaaaagattattgtaaaagatgatgctctaagtctgctttacactggcaggccatagacattcataaataaattcctacaaaatgaaataggaattaatccttgtacaaatactatagctaactaagtacagtttctagaagtatattttgaaatgaaatttatgtatatcactggtgataacttgtactcatttaaatgcttctgaagcattctcttcagaagttaataacttttctaaaataagtcaaatcatgcaatttgacgaatataaattgcagcaattttaccattgctaaaatggtttccgagcattacaagaagagttcacttggctactgtctttacactgaatactttgatgaggttacaataataaagtgacaaagtgatatgcattttcttttataccattttctttaaaaaaaggagtccttaattttttctaagaactccaaaatatgaaagtagaaaaaggcagctatgactgaatacatttcaagaaaaatgtcattcatctttcttaaattgatctgctgagtccagcagaaatgtctccaaggttttctcgtgacgagccaaggctaaagggatacacggagccagcagttagaggcatctagtggggcaccggttaattaactttttcttctatgcttcaagtttcaatgcctataccaataccttttgttctttgcataggatattatgcaccgaaaatgaaacaatactcataaaaacagctaatatttaatgagcatgagtaattgccaattgtgattctcaacacttggcatatatcatttcattcgtttttaagtctactctatgagataagtagcattattgtgctgattttacagatgcaaaactgtggcccagagaggtcaatagaatttcaggtgtacagatataaaatattcatgaaccataatatcctaactatggtataaatataatatgccataaaataggcacgtggtaagtgtttgctgactaaagattgaagaatgtgttgtaatggagtctattaattaaagacagggaatttggacccagaaagatttggcttggtcttatattggccatctactaagacagtttggaaactttatcaataaagtttctattttagagaatatcttagtttgggttccctaaatggaggttctgagatgaagcttcatgcaaaaatgatctaatgggatgtgttttcaagaaacactggtaagggaaaatgaagtgagattgggaagggaaacagaccaaacacatatatggcataaaagcccagggtggcagtgccattcacacttctgaatttctcagttgggaacaagaaagctcacgtatttatgtgtctgcaaccagcagtcattgattaagggcttcccacacacagggacataaattccaggatagatccatctctctctttacacagaccaaataggctctggcagcctcaaggccaccctccaacagagcgattagggagctagttgttgggagtaaaagcacagcagggaaaatgttaaacggatgtgaaaggatatgagtggatcaatgacagcatctctacagagaacttgtttcttcattcaggaataaaaataacgtggaaagttatgaggataaaacagggtaatgtgttcaaagcccttagcctgggcactggcacacagcaacactcactggcactctcttgttgtgaggatggaatgtaatactgtgaagaactgacagcacctggcacatgaaaacatcagatagctggcattgccaatcatttttcctattgcagttgccggtgccgctggtggtggcatacctaaattagaataacactgctatatttaactccaaagtctgtaaaatgcttgaatacctgccaccgtctgtggaggtgagggtgctcgttcaggacctgaacaccatagaagaagcaattttctcaccatctttattgctaccatggtattaggtaagaacctcaggatgcaagaacaaaaggcagcaccttttttgctatcacatatgagatgctgaatttattgataacagtattaaggagaatggcagctgaaaggaaatttctgatatttctttcatgatcctcccagattttgacattcctttcaaaattattagtgagagcaatcagtaagtgtcttctgctaccaaaaatgtgagcccttgcttgaaacatctttaggtaagtaaagtcagcccctaggaaagcacttaagcaaaaggctagggaaagagagctatatcaggtccaaactaccgtgctgctactcctcactcttggaagaaaatttaggcctttgcaatgaaaattaatggagaagcacatgacacctaaatgttaatattaagggaggggatagggagaatatgatatatttctctatgtgactccatcctgtttcatttgttctagtgagtacatattactattatactttgtgtgtaagataaaagaaagtttaaaaaaagaaaaattgaagttattttagaacagatcaaactgcttatgagaggcttactaccttttaaaatattattttgattaaactaaaaataaattcttaaaaacccagccaaggtaagaaaagaaaatagttttccttctcatgctctcaaactaagagtatacataaattggctaagaaacggataggatgactcccctttttccagggacaagagtgggtttaggagataatccagttctctagttatatacttgtttaaaaaccagatgaggagatcacttcctcacccgtcttttgcctctggaggcaaaaggtatggtcagagttcagtgacaaagtgacaatcatcaagggagtttagtcagctgaggttatgtttctctaggcattcttatacagtcagaccatgaaacaagactactgcttccaggaaatgccacaatacctccttattatttacatttctggaagcaaaggcagcagaatttagccactggagtcctctccactgtcttctctagtacaggtagttcctgaacattactccaaatctacagagacccttattgacagatattacagagatactcaccaacatgccagcgaaacatggtttattgttttttgttttttattggctattgtagttttacttatcctcatctattttattagggtcttgttgagtcttcactatcgtgagcacctcagtattccttgtctccagaaagaaaatgtcttgaggttagaaattgtatgtaattaattaattttctcttccatcttaaaaaagatggctgttaattctatactgacatagtatctaataactgcttctttatatcttggagattttccctggcatattcaaataaatagctgtttaaatagccctgacctgtgagtatatatgcccttgtacacatgaatgtatatgtaaatatgcaaagatacaaaatgataaatacaaagtgaaaggcaaattgttaatatattttaactcattcaacagaagaaagaaggcaggataacttcctctataatttcaggttttcttcaggatgcataccacatatgggctacattacaatgttccctccaggtagcaaatatgttcaattttaaagtagacaactgtcggaaattgattttttaaagatggggggtgggcgttgagtaaatctattatgcttgtatattgcaaatgctgtaactattatttttttaaaagacttgactttcactaacaacaaattttcttctttatatgaatatactgatctcccatcggatcatagtgttggacagttcctaatgtaccttgagataagagatgctcaagggtttcattagatttttagagagagtaaaagccaggctgaaaatgttcctggattctatatttgtctcttcacttatctttttaataacactcacacacagacacatttttatactcaacttcaaataaaagtatgccctgccctttcttttgctgataataaatatgtggatggtatagtctccagagagcgaaagtgcccttaaacatttgttttaagatcataaaaactactgttatttttaaagtagaaaaatccatgaatattgaaattgtaaaatcaagggaaaagaaaatagttttaaatattttgggcaaaatcttcttaagaaaaagaatgtcctatttccaatgactctggcacgtttaaacataggaaagaattagaaaaacaattttagtatattttggaccctttaaaatttaagtaaaacattaagatgtattttatacctttactttgaatatgtgataattctcctttactccatagaatacaaaaactctgcaaatatcattatcttaaaaatgtatttgtatatatgtgttaaattgaatctttctaatgaggaaagttaacgttcactctcaggttgttcttatcagatgagtttgtagttgtattatgaagaaacaacacattccttactgacgtctctattagcttagttatttcagttgagaacaagggaaaacataagaatggtattattggagtgtattgctatacattttattcacatcacagtattttatatttctctttttttaagtttgtacacagacaatatctctggaattatttttattaagggatatttaatgattaaataagcactcttagcgaagacctttaagtgttattttttaccaaatcgtatatagcttccacatacaatgcaaacattccagtactgcagataatatacaggggtacacaggtttgaagtagtggagagactgatggaccataagccataaatctttttaaaaaaatcaccaaaatctcagctataatcttgatcatacaaaataaaaagaggagctctaaagaaataaagcaaaaaaaaaaatttataatccacattactgcaatcatctagtttgtgaaagaagagtatgtattttaaattaaatccttaatgatttgatattttgtttttggaacttcacaaccaagactatcctaaggaattcagagctttcctcacaagaccaaagcaacagtgcatgaaattgaactcaaaaagagccaccattctgtgtgacttcttggctgacacaatttagatatttatagctttacgaatgggccactggagaagaacttgaagctttctctagccaggaaggattaatgaacgtgcgcacctggtaattacaccactccatcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggagtatagaagaaagaaatgctccaggagagggaagtggatatgaattgccccctccagaggagccaaacaaattggctgtaggaagacttcaaaagctggacgaacagagaagctcaaagaccttacagatttgggctacttgcccttgctgtgttttttttttttttttaatttcccctagaatgaatatggtttaacttgagagcaaataatggaaggatgcatttttaaatgctttgattcccagctttttattctgcctctaactagctattacaataccacttaatccggacctcagcattccaagtaccaaagcatctcctcccacccactgctcacacgctcctgcatcagaatagaagacttacagaaaagctgccagacccacagaagagcactttcctctcaacagatgtcttccagcttttaggcacacacacactcagacacacttgcctaccttaataaggtgtgcaaaaacctctttcggtccccacggatgcttttagttcagagcagccagcaatgcctccgcacaaagctttgccattgctagtgtgaagagaaagagctgctgggatgctgaatggcacatcagccaactttgtgtgtagcaaaggctctaaagaaatcctgggctgaaactctgctggatcatggattggactcaatttcactccacacacagtctgcattacctgatggagattatttctggaagcacttagggcatgtttgtctacaaaaagatagggcctttttctttccttaacaatttaaaaaatacggtaacaaaccagagacctgatactttaaggaagatcatttattgtgagctccatgagggcctcaatggtctgtttcgaaattgcagccccagcatctagaacacagtcagcacttgataaatatttggctaaatattaaatgctcaattgatatcaggttcaaattagaatttgctaaattatttacacactgtaatgaaagtaaaaaatgcaaggtttgctgaacagctccagagggttaataagagtgtgtgtgtgtatccttttgtcattcaacacacacacacacacacacacacacacacacacacacacacacctgtatagctgatgataaatatacattatatcaatgagttaaaataaagtgtgctattcattcactgagcaatggggctattgcctgggcacggtggctcacgcctgtaaacccagcactttgggaggctgaggcagatggatcacaaggtcaagagatcgagactgtcctggccaacatggtgaaaacccgtctctactaaaaatacaaaaattagatgggcatggtgacgcacacctgtaatctcagctactcgggaggctgaggtaggagaatcttttgaacccgggaggcagtggttgcagtgagccgagattgcaccactgcactccagcctggcgacagagcgagacttcgtctcaaaaaaataaataaatttgtaaaaaaagatttaagcaaacccactgataacaatacttagaaagtttgttgaaaaccgtatgtattatttgcttattgccctgacaatttctaatatcataatagttcattataatagcccattcctcagtgaatgaatagcacacttcatttgaactcattgatacaatgtatatttatcatcagctgtacaggtgtgtgtgtatacgtatacttttgaatgacaaaaggatacacacacacacacacacacacacacacacacacacgcacgcaattattaaccttctggagctgttcaccaagccttgcattaaacctggattgaataaaagactcccattcctcaaggaaattttacttcttctatgaggacttctcagtaaccctaaattcacaggcatattctttacatgttactgtcccaaagcaaaatgcaagctggcatggaaccaagcccagaggttaattcctgaagctagaggaaaaggttccaaagtgccctacatcccaaggtcgcccaacagatccacacctggaagcaatctccgccaagcgcctatttacaggcacaggtgtgtgcctatcgggacagctgaggaacacacctaatttgatagatgacattctgatgtggcaggctttattgtgctgtttatgacaatatctgcagattatgatgtgcttgtttaataaacagcgtaattaagcacacacaaaacaaaacaggaagttaatacctaagtggtgctgacgtgtttatgtaccacaactgactagtgtattctttactgcctattactccacttcttaatatccactgaaggaatcctcagtctgtatacacacatctccaagttatgaacatcaacttcatgcatatcctcagaaagacctacttacacctgcagcctcaccacatatatctacacccttaacaggcattcaataaatacttgtcaaatgatcagataaatgataaatgaaggagaaacataccaatatttatatcttcaagattgctcctatgggcatataattttacaggagttgctacttggattgtctatcttttcagtctacattttttctctaaaatataattggcagttgccttatggatagattaaatttgatagagcctggtacttgaggtgctatttcagcaccatttctgtaattctggaactagttatcaggcttggcagatgcaaatgtatgcagttttgatcttcttcccgactctctaactgcagattttacaactgaagaaagcaaggggaacttttatttataaataatcgatacaatttgtaaatagaaatcctttccctctgagcagctcacagccagccagctctcagatgaaggtacgtcagctctctcttgactaatggtgtggtctgcatcatggaggttaccagacattccttggcagaatgcaaatcaaacatcttgaatggcaaaaggatcaaagcacggcatctaaacattgctcagacctgctgttcatatttttatgcatcagaaaacttgaaagagaaattagaattgaaagataatgcacctgcaccttccaaagtgtataatattgagatttttagcatatttgtccctctgggattagtatattttattccattgtagggcagcagctgaacaggggtttgtggaggcagaagacttgagagcctcttggctcaactacctgtaagctgtttgaccttgtacaagtcatttaaactttctggcttcaacttccacatccataagtggaattaataatacctcatcaagtgatgagaatggaatagatattaaagcactgctcctcaaaatttaatgtgatacaagccaggtgtggtggctcacatctgtgatcccagctacttaggaggctgaggtgggaggatcatttgagctcaggagtttgtgaccagactcggcaaaatagcaagaccccatctcaaaaacaaataaagaaaaatgcatcgaaagtaaagaaaaaagaaaaaaataataattgaatacaaatgaccttaaaaaaagcagagtttaattcattggacctgcggtggtgcctgagagtctccatttccaataagctcccaagtggtactgctgctctgtggaccccactgtgtgtagcaaatatcagtggaaaacactgttattcttccaaatgatagtgaatttgtgtcctattgccatttttatttggtgcatgttttccctcagtatctacccaaccgtcaattactagatgcttgtctacggcaggtgatgtgcaggacatagatattttaaagtttacaaagacattgccctgtcctcaggaagctttcaatctatgtgagaatgaagatcacttaccactacaaacagtttggacatggaggaccaaagctacctaccccttatgctcacatagctggctgtcgacattaacatggtttacctttccattgtcttcattagcataactttcctattacagataactcttggccaggcaaataatttgactgttcactaaagtaacttccccaaactcccatcaactcttcaacaaaaaacatcaatagagttcacaccttaatagtctctgagcctcttggctagaaatcttcactgtgctgtttccaccaaactaagttgtaataccatgatccttacccaatcctaattgtgcccccacagtgaaagaccaatcttaaaccaagcttcatactcccaatgaaatccaacctcacctttctccttatgaaatactaccaaagctttgtccaggctgtggtctttcttaccatagtaagcaataaatttaactttgtcttatcaacaggttgtattggtgatgtttagggagctgaaatttcccatatggaagaaatagacatgggaatcaaacgtatgttacaaggagataagcagtggtgccaaggggtggattaaaagactctagctccttttttgtcataacaaataaacatccaatttaattataatcagtacattttttctctgcaaacttagtttaacaacaagtcccctattctcctcttatttactcacccaggcatttggatgttatcactggtgccatcattgattgtgataaaatatttgataagttttatgtcctcaatgcttcattaacagtataatacatgagagtgacattaaccaagattaagggagaaggggaaatcttttggtggttgtgatgtcaaacctaaaactacatggaggcccagaattagggaaaattcagcatccagacagacaatgtaagatcacggtattttcagggaaaaacatgaaccggagcaaaagctcaaaatggggaaagagcgagagagaaactaagggtctaaacagtcttttatgtcaagttaagtggcttatgtctttgctacccaaagtatggtctgcaggccaaaatcattgctataaccctgagcacttgctagaaatgcagaatctcagacaataccccagacctactgaatcagcatcagttaattaagaaaatccccaggtgattctgatgcacatcaaagtttgagaagcactattcaaaataatatgctggaggctacgggaagctactgaaggattttaagaagggaagtgacataattgaatttgcattttagaaaaaaaattactctgtgtccattcattccttcaggatatatatgccaagcattgaccttagagctggaaattcagcactattttgagtggattagctgaaactccctattcagtattcattcaatgaacatttattgcattccaactttggttttttttttttttgtttgcgtgtttgttttttgcttttttgaagacagggtctcactctgtcatgtgggctggagtgcagtggcatgatcccggctcactgcaacctctgcctcccgagttcaagtgattctcgtgcctcaggctcctgagtagctgggattacaagcatgcaccacaaaagccagctaatttttgtatttttagtagagatgggggttttaccacgttggccaggctggtctcgaactcctgacctcaggtgatccgcctgcctcagcatcccaaagtgctgagattacaggcatgaaccaccatgccccacctgcttgcaaactttcatttgacttttccaaaagcttgatttggaaataatcccacactgatggctatgtttttaatggagtcaacctttgttgtccaggacaaataactgttaagaatcttctagcatactgtactcaaagtccttagcactatcaggctgttggctcaaacatgaaaggtttttttgatgtagttttgtagaattgttattgcaatggtatttgctgtattggaatttgacccacagtacaagttatagtacaagataccaatcaatattgttttttgttaatgaacaacataagatgtacagcttgccaaatctaaactttaatattagagattataggatcagtaccattttttgctaacctatgcagaggattgtcctttggtgactgaaaaggaaaacaataaattcctacttatgtggagtctctgtctttttaataatagtcagtgtcttattggaactcacaaagacttggtgtgaagagctctgacaagctagttagcctattttatgcttgttttattcttgcttcctatatgcaaacatagtgaaggacagcgggcaatgagctcgcacttctattttagcgattctgggttactcgggctgcctctaatctaccaagccaggattattataaggaaaataaccaatgtagctaaagataaagtcatcacttccctaactcaattcctttgtagctgcaggaacactaaatttcattcagaattctaactcccaaaaagctgggtaatctaagacccttaatggttttcttatagcctcatagggtttggcaggtgccctggacatctggcagattccctgagagaacaaaaactcagaagctaccaaagattgaaatactcccttcaatacccaccaactaggggagcttatacaagaccgtgggtttctttctactttgttcttttatttacataatagcaatgataatatctttgttgtagaattactcggaggattaaatacaagaaaatatttacagtacctagcacttaataaactctcaatatatattaattttccccactcccttctgggttactaagacccctataaaatgcaaatttatttacatcacagtagtcactaatatttttgaaaagttgagttaattgaattaggaagcctgttataaagaataagccctgagtaaagaggatgtgtattatgttctctaaggtatgtgaagtgtgtgaaaagaaggtccaaaaaaggagggcttgcttgagatgactgatatccaagaagatagtacaccctagctgtcagaaccattgactttaagggctgaagatatcataaaactatccattttgcagatgaggacactgaggctaagttcggtgaaataacttgcctaggccttagagttagaacactagcaaggcaggattgaaacctagtgaatgagaggcttcaaaaagaaagaaaacaatgtggacacagggaaaaggtgagggagagcattaggacaaatacctaatgcatgtggggcttaaaacctagatgacgggttgatgggtgcagcaaaccaccgtggcaaatgtatacctatgtaacaaacctgtacattctgcacgtgtatcccagaacttaaagtataataataaaaaagaaagaaggaaaacaatgtgaagaatgaaagcaggatagggaaggagggagcgctacagctcagggtgaagtcttgtatcccctttgcctctgtccccttagtagtaaatatttctcggggtgaatcagtaacatccctcagcctctcatacagaagtgccagagtgtgatctggctattctgccattaaacattcaagatcctctacaaccatgaacatagaagaatgatttatccttatgttcttgctgtatcaaagactctcagagattttcagagacatgccttttccatactgatcaatgaagatgggtcaccagaaacatcgtagtcaaagtgacagtttttgtactgccttcccagataattttacagactgacatgaatttgaagcaacaagcttttttttttttttttttttttttttgaggcggagttttgctcttgttgcccaggctggaatgcaatggcacaatcttggctcaattctcctgcctcagcctcccaagtacctgggattacaggcatgtgccacaacgcccagctaactttttttttttttgtatttttagtagagatgggggttcaccaagttgatcaggctggtctcaaactcctgacctcaagtgttccacccacctcagactcccaaagtgctgggattacaggcatgcaacaagcatttttatgaagaccctgcctgaatagccattcattccaaggggacttgaatttgaataatacctccacacagatgactctcaaatctgcatctctagcacatacttcttccctgaatcccatactttcatccaactgcactctttgtgactttactgggatgtctaacaagatttcaaacctaacaattccaaaacaaaattattgcttccacctttacccctctaccatctaacttgatccttctaccattttctcaattctattcaccttatccaccttggactcatcctgggctcttctctttctttcccaccccataccccattcatcagcaaacctggtagtgctaccttccaaaaatacccagaatccatgtacctctcattgttttcactgaaagcttcctggtttagaatcaccattatttctcatttgaattattgcaatgactccctctgcttcaataggtactcttactctctgttctccactccgtggctagaacaattcatctcctttctttccccaaatgagtttacttagaaaactcccttgaaaagacaaaatcatagagatggagaacagattaggggttgctagtgattcaggaagtagaatgggagattggatgggtgtgacaattaaagggtggcttgagatagttcctttgtgacgctggaactattcagtaccatgtatcaaaataggggtagttgttatatgactctaaacatggtataaaattgcatagaatgacagacacagataagtgcatgtaaaagctggtgagatctgaataaggcatagattgtgttaatatcaatttcctggtttttatattgtgcatagctatgtaagatgtgagatctgaataaagcatagattgtatcaacatcaatttcctggtttcctggctttgatattacatataattatgtaagatgtaaccattagctgaagatgagtgaagggtactcatgatctttcttaatacttttgcaacttcctgtaagtgtatatgtatttcaaaataacaagtttgaaaaatactgcatatacacggcattcctcaagactacggattttctgtttcttctacctggaatgctctttccccaaatatgtaaatggataatttctccccttccttgagatttctgttcaaatgtcacctcatagaggtctgcccagagtgtcatacataaaatatcaattttggctcggcacaatggaccatgtctgtaatttcagcactttaggggtggaggcaagcagatcgcttgagcgcaggagttaagaccagtggtactgaggtagtgaggtactgctataaagatacttgaaaatgtggaagcaactttagaactgggtaataggcaggggttggaacagttaggaggctcagaagaagacaggaaaatgtggaaaagtttggaacttcctagagacttgttgaatggttttgaccaaaatgctgatagtgatacgaacactgaagtccaggcagaggtggtctcagatggagatgaagaacttattggtaactggagtaaaggtcattcttgctatgactaacaaagagactggcatcattttgaccctgacctagagatctgtggaactttgaacttgagagatgatttaaggtatctgacagaagaaatttctaagcagcaaagcattcaagaggtcacagagcataaaagtttgaaaaatttgcaacctgacaatgcagtagaaaagaaaaacccattttctggagaggctggctgtagaaatttgcatatttaacaaggagcccaatgttaataggcaagacaatggggaaaatgtctccagggcaagtcagagaccttcattgcggctcctcccatcacagacccagaggtctaggaggcaaaaatggtttcgtggaccaggtcccccccccaaccccaccactgtgtgcggcatcaggacttggtgccttgtgtcccagccactccagccatggataaaaggggccaaggtacagttcggaccattgcttcagagggagcaagtcccaagctttggcaactgccacgtggtgttgagtctgtggatacacagaattcaagaattgaagtttgggaacctctgcctagatttcagaggatgtatggaaactcctggatgtccaggcagaagtctgctgcaggaatgaagacctcatggagaacctcggctaggacagtgtggaagggaaatgtggggttggagccccaacacagagtccccactggggcactgcctagcggagctatgagaagagggccactgtccaccagaccccacaatggtagagcgatcaacagcttgcaccacgtgcctggaaaagctgcagacactcaatgccagcctgtaaaagcagccaggagaggggctctaccctgcaaacccacaggggtggagcttaccaagaccatgggaacccacctcttgcatcagtgttacctggatgtgagaaatggagtcaaaggagacaacttcagagctgtaagatttgactgccctgatagattttggactggcttggggcctgtagccccttcattttggctaatttctcccatttgtaatgggtatatttacccagtgcctgtgcttccattttatctaggaagtaactaacttgcttttgattttacaggctcacaggcagaacagacttgccttgtctcagatgagactttggacttggacttttgggttaatgctgaaatgaattaatactttggagtactgttgtcaaggcatgattggttttgaaatgtgaaagggacatgagatttgggaggggccaggagcaaaatgatatgtttgggctttgtgtccccacccaaatctcatcttgaattgtaatccttataatccccataatccccaggtgtcaaaggagaggctatgtggaggtaattgaatcatggggttggcttcccccatgctgttctcatgatagtgagtgaattctcccaaaatctgatggttttataagggtctcttccccctttcctcagtacttctccttcctgccaccttgtgaagaaggtgcctcgcttccccttcattttctgccatgattttaagtttcctgaggcctccccagccatattgaactgtgagtcaattaaacctctttcctttataaattacccaatctcgggcagttctttctagcggtatgaaaacgggctaatacactccctctcttgagatttctgttcaaatatcacatcaaagaggtctgcccagactgccatatataaaacatcaatttcggctgggcatggtggttcatgcctgtaattccagcaccttaggaggtagatgtgggtggactgcttgagccccggagttcaagaacagcctgggcaacacagtgagactctgtctctataagaaaagaaaacgtgttagctgggtatcgtggtacatgcctgtagacctggctacttgggaggctgatgtgggaggatcatctgagcccagggaggtcaaggctgcagtgagccatgatcacgtcactgcacaccagcttaggcaacagaatgagaccctgtctcaaaaaatatatataaataaaaaataaaacatcatgttcctgtcactttttccctatcttgttagtttctcttttcttcttaacactttaatacttccatttgaaataccacatatttattttctcctttcctaacttcccattactatatgagctccttgaaaggacagcgtttgtctgtttttggttatccttgtgcctatattagtatgtggcacacaatagtcactctacaaatatttgatgaattaataaatgagtgaacaggtaaagctagtagaaggaacagtcatgcagattggcttaataggaaatacaagtctgacaaaatcacattccttggcagtacttaaaaaaactgggaaggaaaaagaaaacttgctcctgctgcttctgtgatacaaagaaaaacctcattattagcagtttttttaaataataaagttgagcattaccatgtagaatggtattatggacagaacacaccacatatgtataaaaataagtaacttccctgggaagaatcaatacagatagtccctagattacaaatgagttgtgttctgcacatttgaaagacagctgcttaatgatctgctcgatgctctctaaattttctgaccgggttcacttcacccctacctgtgcattcagtcatactctattccctggaatcaccaaacctgtacctaacagaggaattcaatgtggttacatttcataggttagtccacaaaataatagttcacttataaacgagctgaagtatagtgtaaataatgctggttttaactctgcacgttgtaagtaattcaaatgcttagagttgtatcacatttaatggtatatttacctgagaaaggcaatattaaacgtgcaaggaaatgtgggccttgaagtcaagtacactttgaaatcaaactgtcactctgatgctacctttgtgatgttggtccagtttcttaacttcttgaagccttaatttcctcaactgtgacttggagatgatcattgagactacccaccaggattgttttaggattaaaggagataagtcttcagcacagacttagtgttccataacattacatcttattatattgagcacttccagttagtctgagttacaaatgatattttacacatcatcgtaaaccaacggtctaacaacgtccctgatacacggttaatgctaaatatgtgaggtgaatgaatatttaacaagtacattgattcacatactggagagggatgaataggcatgaaggacaggcacgaaggcctttaatgtttgtgagcctatccatctatgatgttttccttttaccttcctcccattaccttctaattctctactcacaggtttgctaaaagatctctcttccaccaccactccttgtccccacagtgggaggagcatgagggaaattcaaaaataaataccacttatgtagcattttttggttggaattttagggtcaatatttagttttaaaatgtgttaaatgtacattttcattaaaaagaaaagaaaacatgatttatacaagataagcatgacttcttcactgctgcatctttttgaccttagtttatagaatctcaactgcagcctggggcctgccccatctctgaagaccgtgctgcccaaaggatgaggatatgaagtaccctgttaaagtaattcattggcatgactgcttggtttgtcctggattaatcatctctctcaaggagattttagcccatcggcccattcctgtgcaagatgcctaacctgattcctaggctcccaagctagaatgaagatactagctacaagtcctccccaatgctagactaacatacaattttgatctctggaattctagtcaatgatcctaccaatgtgagctctacctcttcatggcccctaaacgctgatatctgctttcagccttaccatataatgctcttatgctcttcctcttgaaacacatgttaagaatgacccatcttccctttggaagagtttaagcagttttcataatctctttaaaaaaatttgactggcatcaaatcaagctctgaccaatgacagttataaaaaaaaaaaaaaaaaaaccaacaaaaaaactaaattccctcagagaaaacaggaaagtatgggagcaactttaagaaaacacttggaataataacaaactgttacttaatatttaacctatcttttccccgaagggctcaagctgattattttcttgcttttgacggctagtgaaaataattggttcctctcttctttgtcacctccttgaactattaagttttcccttgatgttttctcatgcatgaatatgccagtaccacttacacaggtcttgtaaacaagtttcaaaagctattagacccacataaattacacaaaatatgtttcagtccctaccaaatttcctaaagccatagttcgtctgtccacatcaacccactcccttcttttattatccctgctttagctaccttgtcactcaaataaactgtgtaattcacacctgctttgagctgattggttgatctgtccttgattgtcccaggtggatttattctcccttaagcttcaggtaggaatcctgcaggttcatacctggagaaggagataaacctatgccttaaatgcaatgttcattaatggataaattcataactggcaatggtaccaagagttacagcatcttcctctattaaaagcagagcagcctatgggatggccaagtccttgaaggtgacagggatttgacaaaaatggagggtatgaatgggctatattatagttaatgatttgaaatcattgtttagaaataattgcctagacaagataagttaactgatctctacaaacttgcattatatatatttctcatcactatgcataatttttattatagatttgtcccttgaggtccagaagcacaaagcattctcatagtcccccaacaggcatctttctttaagagacaaagcaaggcaataaaaggggggtattttatttatcgcccaattcacagcatttctgtcttgactctgagaagtgtaaattcataacaggaggtttctagacatacatatagaaggtgatgctggtgatccaaaaaatattgacaattgataaagaaatgctgaaggaggtgtcactattactagaagtaaaagttttaacaataacaataaatgaggcctctttctgtgtccatctgtccacaatcccatgccatctaccccttctctagagttgccatggaagagaaagttccactacttcagttacgtcatttctatttggaggaaagatgggggtcattttttctaattgaagagtgttgtgacatttttttcctcgcattgtttcatttcatttcgacttatcttttttcccacttataatgtgcatattattttttgacatcaagataatgacaataaagaaaaaaaactcactgtcttctcaattttaaaagaaaaaatagcaaggaaaaatgatcagctaaaggatttaattttaatgttgtgataagctatttttctaaatgattttccacataatctgtgctttagcaaagatcttctcttttttttctagtttccatctgagattagataatgggctgtatcccattatgtgcatgctgtaactccaccacacctgttacttttgacatatttttatatttctcaataattaaaaaagaaagagtgggccaggtgtggtggctcatgcctgtaatcccagcactttgggaggctgaggtggatggatcatctgaggtcaggagttcgagaccagcctgaccaacatggtgaaaccccgtttctaccaaaaatacaaaaaattaactgggaggggtggtgcacacctgtaatcccagctattcaggaggctgaggcaggagaatcgcttgaatctgggaggcagaggttgaagtgagtcgagattgtaccattgtactccaacccgggcaacagagcgaaactccatctcaaataataataataataattattattattattactataagaataaatggtagcttatttttacctaaacgtagtagtggcttcatgccacagttgctaatctctgagccatctcactatcctttgttcagcttgttaaatgtctctatactttcgtaactagttcctcatagtaaattccttcttccagaccagtgtttcccaacctcaccacaactgacattttggacagaataattctttgttgtaagagactttcctgtgtcctgtacagtgtctaccaatatctctgtctctaccaaatgaataccagtaacactcctgcaattgtcacaaccaaaaatgtctccagaaattgccaatttatccctcagcgtgcagcagaatcacccctggctgagaaccactgtattagactagaagatctttacttttctgactgactcctaagtgatatactcctttcaagcgcatatttatacctgttatatgtaaaaataagattggaataaaataacatctatctatctgtgtccctataaaattagtcatactgtggtgatatctacatctctataaaactagtaatattggtaaacaataaaagcttattcagcaaatgaatatattgatatgaaaagatctgcaaaaccttgatctactttttccaaaattaatacatattttattttgtccagctaatatttaatatatttttatttaattagccatcatagggcctttgaaatagttcatacattatgatgccttatatactaaagtgagtaaaattaaacatctgttaatacggctgacacagaaaaacacagtcagataggcagttttagagaggagaaatatacaataatagttcttctttttcccacctcacattatgaacagggaagtttttccttagcactaacatctcagcaatacgtaaagatatcacatcccttattttgtatttattaatccttcttttaatgcttctgttgctaattttttaattgactttgtccttaccgaatactagtgataggatttataaaggatgattaagtcatggactaatttaaactttgttgaactcatataacagtgagtttcaatgaaatcacactaagaattctctgtaatgctttgttccagctataagaaaacaatacccaatttcatctaagagatgaaaaataaagaaagtatgtgaagataatcatattcaatagttattatattatgataatttgcatatgtagacatccttgaaatgtacatagacctttattcaagatctttcccatacatttcagaattcgtttttatcattcatacatttgataaacatattttaagtgtaatatttatcttatcaacatgtaatgcatacttaacaatgtgtaatattgatcttatcaatgctactctaccaaaattaaaagtagatcattaaagaaaaaaatcaaattcctcttaatgtcatagaaaaacattcttctctattaagataaaggacaacttaataaatctaatattttcatagctcatataaagaaatatagataggattagacaaatagaaggaacaaatgaaagcccagtagattaccagtgttttgagccttaatttaggaagttatcaaatatgtacttattcatttcagggaattgtatggtttcagaaataagaaaagcgacaacaaaacggtcaaatttgcctgaatgattggtcagctttgttcattctaaacttaataatcctttactaattcagcaaagtcttataaaaaatttatcaggtcattgttcataatgatatgagcaaaaaggaaatggaaatagataacaggtcatatgatggatttcattcaaatgttataaggcattttgtgttaaatatttgtcattcatattacatagaaatataatttatgtagaggaatgtaataaacattactctttttaaaaacatcagtttccgaatatgccacagaatcttaatttgattgaaatgccctccctctcccttctctcaacagtgagtcttattttgtgttcaatagcaactaaatgtttccagactgtgaagcctttctcaagtcccacaacgggagttatatctgtcacctatgatcccacagcaccctcttcatcctctattataaaatactaccattttagacttatactctatagtgttctgattttgcccatatgcctaactcacacatgagatcactaaggccagaaaccatatgttattcaattttctgtttatgtggccagttccttacaaccttgcttatataaagaggacattcacaacatgtttataaaattgaattcagctgaaaatttttaatgagtttgcactgagaaatgagataaaacttgaaggtatttgcatgataactgaaaagctgtggatcaaatcaaagatcatagaggtatcttggaatacaccacagtttggaggtatcagaatgatctggctaagtatttgttgcagtataggattttgttttaaggacattaactgctcaattaaaaaaaaattggactcaattttattttcagcttgtgatacctgattttggtgtgtgtgtgtgtgtgtgtgtgtgtgtgtgtgtgtgtgtatgtgtgtacttttacattttcagcagcatgtggcaggtggctttttagggtacactattcctgtgacctgttgacgtgacaaagaggtcgttggagaaaaaaatcactcctcatgagtacagtagtatcccaagagaggcagatcacactcacacatgacataagaatcaagttttactgaaaaatcatagaggtgtttttagtaaagcaattaagaaaataatctttttcttatatatttctgatgcttcctaaaaattattattatgattatgattattattgagacggagtctagctctgtcaccaggctggagtgcagtggcgcgatctcggctcactgcaacctccgcctcccaggttcaagtgattctcctgcctcagcctcccgagtagctgggattacaggcatgcgctgccatgcacggctaatttttgtatttttagtagagacggagtttcaccgtgttagccaggatggtctcgatttcctgacctcatgatctgcccacctcggcctcccaaagtgctgggattacaggtgtgagccaccgcaaccagcctcctaaaaattatcttataaataagactaatcaattaaaatattttaaagatatttttcttctaactatacttccaaatatttatatgtatgctttaggaaattgagtttttaagtgaaatattaaagacatctcattttcctgttacctgattactgttcattcaacctgttgctgtattgttccatttttatatgatataccataagaggctatgtgtgaataaggcaatatacatgatgcagcattactttgtattcacattttcaaggtgtatagaaaatttttaaaaagatgttaaaaaggtaaataagttcattgttaattgttatagaaagagtagacaagagagaagactgagtctacatttcggcaaaaagtcttcataaaaattagaaaattggtgagtaagtcaatgaagcattgtcaaagtcacaaacaaaaggtgactccacattattataattcccctgtcagaaagtagacatggcaaacttatgacttcaacctctgaaaatgaggatcacagaggagaaataagactggacaacaggcttccagctgtgtttctaacaagtataattacactggttggacattatcattaactacatttctaattcttctcataattcaaaaagtgagagagaaaaaggaagggataactctttttggtgttatagtacctcattgtaggtttccaaaaacaagtgactcctgacaacaactgttagctctgaagtgagagtctgcaaactgcagccctcaagccgtaactagcccattgccatttttgtaaataaagttttattggatcacaatgacacatcttcatttctctattgtctatgactgcttcaacattctaacagcagagttgaatagttgcaacagagtatagaaaacaaagcctaaaatatttactctctggccctttacgtttacattacagaaaacacttgctaacccctactataaaacaatgttgtctttggaagctatggtaaattaaaaacagaataaaactattgctcacgtatattttattttcaaagtaaaattacttttttccccttctatagatattttttttttttcctggaaggagcttccaatttcaagcaagaacagaagcagaagcactccaataagtgtgcttggttacatgaataacttgtgatggtttggatatacttcctggcaacacgcaatgttagaaacctagaaatatgtctgcctggtacttttaaggggaatatatagagagcctcttttgaaactttgaaaagatttattttctattctggagacattttagtatggagagttgaaggttgcataaaaatacagcaactaagatagttggaatagttattctctagggaaacatttggccctaagacaagacatgttggaaacacataaacaagcaaataaaattggcaaatgtaagttttgattcatatatgctcgtgaaactatattcttaatgctattgagaggtgaggccagctggactttctgggtcgagtggggacttggggaacttttctgtcttacaagaggattgtaaaacgcaccaatcaggaaccttcccgtcttacaagaggattgtaaaacgcaccaatcagcgctctgtaaaatgcaccaatcagtaggattctaaaagtagccaatcgtggggaggattgaaaaaagggcactctgataggacagaaatggaacatgggaggggacagtaagggaataaaagctggccacccaagccagcagcggcaacctgcttgggtccccttccacgttgtggaagctttgttcttttgctcttcacaataaatcttgctgctgctcgctgtttgggttcgtgccacctttaagagctgtaacagtcaccgcagaggtccgtggcttcgttcttgaagtcagcgagaccacgaacccaccggcgggaaccaactctggacacactatgaccttaagtaagtctgtcttcatggatcctagatatttcctagcctttgtatcttccttaaaggttaccttcaggtgcttttgaagttgttatgaccacatgtacagtccttaccttttgtacatgaaactcaacttttgattcctattttatgtttccattagatggctacgtatgtaaacaaaaaaagtttttgtgacactcaggcattactacggagggaggtgaacgttcattaagacatttatctcaaatattgcatccagaagaatgacactaagaataaactcaattgaagtatgagataatgtgcttcaaagactaagggactaaataactcatcctcttcctaattaccttatagataccttagttctctttatccttctccaacatacaaagctagttcatttttaaggtctttgcataagctgtcccttgtgcccggaatgctttgcccctacatcattacatggctgactctagtttgtccatcagttcttcttcaaaatcaccttccaagtgaggtattgaagactttttcaagatttttctcttttttattaattctgtgcataatatttcccactttctaaattgttttcctttctcagtttgtatcctatccctgcttactaaaattacagtttcatgagcacacgggacctatgcttccttgtacgtagtgtgcaggatattacttggaatatagtgggcacccaatatattaatgaatacaatcattgtagaaagttaaatccacagtggtccagatgtggtgttaagcatgaacctaaatcttctaccttcaaggtgctcctaatatggttgggttgatgatcacatacaaatcagataattataccacttgaggaacattaggtttacaaactaagcattattatatcattttattaaaatgtattcatatcagtaaagtggggacggtggagtcaaggaagaagtattgtaggtgacattttagctgagtatagaaagggaggttagggatgaagcaccaggcaaatgcttgtcacaagtgaccttgtgagtcacttgtgacatgaagtgagtcacttgtgacatgaagctgtataacgtgcttagaggaagacatacagttcatcacggtcacctttcgtcctgacatccacattcatttctctgactacccaacccctcacttggatttttcaaaggtatctcaaaattaacacatccaaaatacgtttactctctttctctgcaactcttttcctctccccttatgcatttaaccattcattattttatccaatacgtacttactgatcacttattattttcccatttcaaaagaaatggcagtgttatctccagaggtgtatgacatcagaaactgggaatgatatatgacactttcctcaaattcaactctgcaatcgttcaacttaacactaacccccgtcaattacgtctcctgtatttttctcaggtttgttgtcacattctcactagaactattttagtcaagaccaccatcgcttcttgccaagattacaataataacctcttttgtccattcagatttgcttctctctgaaccattctccacacttcagcgaaagaagtctctgaatcaaagctctaatcatgactctttcctgacaaccacgtgacaaagcccttctgggcagagaaaaaactcccaacaggacccgaaggaccctccaggttctagccccatctcctctttagcttggtctcttgaacatctttcttccaaacataatctgctgtcacattctttctgttcctttatctctgacactctcaggcttagctctttaaatgtggtactctgcatagaaaaatttccaccaccttcacggtagttttgtgtggccaagtctatatcacttcttcacagaagcttttggtgacccagatactaattcaaatttctaactcggacaccagtggttcccctttctctctctctctcaatctctctctctctctctcagaatctcatgagattcatcatggttgattacttgcataaagtctgacatccctgctgggattatgtctgtcatgttcacttctgtatgctcagcatctagttataattaataataataatactaattactgagggagctaaatacttatttgttggatgagtgattgtggtaaaaatgaaaatgaaatgatgtaaaatagtggaatgataaaacagagtgttgaaaatgttgatgagagccagattataaatgctttgagaaatatttcagaggctgtgctgacaggattttggtagagatttgggcaataaagagccagaatggatagggatatatgataactgcagggtttttcagagaaagtgaattataaatccatcagtcaatataagaaatgcagaaagaaaaacaatgttgcggatgttagaaaggattgagagattctgaagtgatgggatgttcaggaaatcgaagttaagatatctagtaggcaagcagaaacctaccttatggccagaacattctctgacccaaaagtctcaagaccattttttttttttttacaactaatgtcaataaactacttttcatgtacactagaaatgatagtgtgaaatatattaatgaggttaactattgttaaaaatcagaatatgcattcctaatatgtgtttgtaaaataaattttattgtatatatttaagggataccacataatggtgtaagatgcatagatatttatatatatagtgtaaaatagttaccattgtggagaacattatcatatctatcatttcacagttacccatttttcactctgtggcaagaacagctataatctattcatttatcaaaaatcttgaatacacactattattaactgtagtcctcatgatgtatattatatcttttaatatattaatatattttaatcatttgtatcctatgacctacattgccccatttcctcacaactaccctgaccctggtaaccactgtttaattcactatctgtatatatttgaccttttttaaaaaaagattccatatataagtgagatcatacaatatttttctttcttggtctggcttatttcatttagcataaggtcctccaggtccatccatgttgggacaaatgacagatcttcttctttttaaggctgaaaaatattccagggggtgtgtgtgtgtgtgtgtgtgtgtgtgtgtgtgtacacacgattcttggaccatatttctttgtaaactgttttctacatattcttagcccttccatagaaaccccagattctctctctctctctctctctctctctctctctctctctctccctctcctcctgctcctcctcctcctgcctacatctctctctcccttcctcttaaagtaactctaaaatataattttaaatattcttattttgtctggtgccagactgttttggacactagccataaaatatttttagctgtgttcatttaagctaccatacaagccaggcgctacatctacagaacacctttctttttactttgtaagttcttttataatattggatgtggtgatgagataaagaaaagagtgaggtataatggtcttcctaggtatcagaattttctttttgagaaactgtttttcttcctttagtaacgaaaacaagagccaacataatgatctgagttctgataatgagtgtgttttggcacaaactgtcacatgaatcaaaggtaacttgaacatgtataaattaacattccacagccagaaaatatttagattcactaaatctgttactctaagcaaaattcaggagttaagtcaatgatagatggccattttggtgtctggatcttaggagaaaataggaccataagaaataaacactgtccttacaaagaaataaacttttgtcctggagttaaatggtaaaaaggacgccccctcaggggagcataccttgataatattgatcatccaaataggatgatatggtttggctgtgtccccatccaaatctcatcttgaattgtagctcccataatccccatgtgtcatgggagtgacctggtgggaggtaattgaatcacggggatggttctgtgctgagggagctaaatacttgtgctgtccttatggcagtgaataagtctcaggagatctgatggttttataaagggcaattttcctgcacacgctcttgcctgccaccatgtaagccatgcctttgctaccccttcaccttccaccatgattgtgaggcctccctagtcatgtgagactgtgagtccattaagcctctttttacttataaattacccagtcttgggtatttcttcatagcagtaggaaaatgaactaatacataggattattgagaaatatacatcaaatataaaatgtgatttttaatgattttttctcgattgatgtctgatggagactaagtgcttaatatgaaaacagaactcatggtgttttcttctgcggaaagcaagttagtgtagtccaggcttgtaacttgctggtataagaaaagatcctagactttccaaagggaaaaatggacagaaggttacatcgtagggtcagcagtttcttagatgtggtcatctggttatagtattactctgaaatattacctccttctaggtttttgataggagtgggattgcagacaatttgaagctctactttatgatgaaagcctggtgagctctaattgagaaatacagacctggtttggatactaaatgagtaggtgtttattaacacactgttaggaaaattgagaattctggcaggttttagtgctcaaagtaaaacctttcccatttacagagagaggtgggcttggagagacccttcagaatgagttgggaccttcctgaagaaggagctctggatccgttcaagcatcactgtgacttctgagagacacgtctctattagtccattttcatactgctataaagaactgcctgagactgggtaatttataaaagaaagaggtttaattgacacacagttcagcatggctggggaggcctcaggaaacttaccatcgtggcataaggtgagaaggagcaagccaccttcttcacaggtggcaggaagaagtgcccagtgaagcaggaagagccccttataaaacaatcagatcttgtgagaactcactcactatcaggagaacagcatgggagaaattgctcccatgattcagttacctccacctggtctctctcccttgacatgtggggattgtggggattacaattcaaaatgagatttgggtggggacacaaagccaaaccataggatccatcaaatcccaggatgatggttctccatccccacaatgtgtgcaatattttaggagtcttttgttactcataatagctaaagtacagatctttgcaagtagtttcatcttccacgagtgaaagcagattcaaacaaaaacattactctcacctgcatcatacgttttcgagagtgagcagtgtgctggaaattgccccaacccatgctgttttatgtaagccatagtccttagaatgtaggtactcagagaagagcaggtacttttttgtgctaggaagaaacatggccaagcaatactgctatctgacgaggaagctgttgttctttaacctggaccattttcagagtaggcattttaaaagctgcctgatgagaactttttgaaactgtagcagagcttccatggatattctgattggatatatcattgcttcctgctcagcttgctaagataacttgaaaacagaaaatccttttgtctggagtaggtatttaattaaccaaatgttaagtattgtgtattttttcagttgcttaagtggaaagacattattacctgaatatagtttttttatgaacaacccagaatattaccgggttaaaggtcattggtttattacttaacctaaaaataattgctttgacatatatggaatattgtatatctcattattttttgataacttcagaagagctaatataatcggaggcagatctacagtggaatagggaattcagaatttatattctaacagaaaaggatacagtaatatgacaaggaaattcctaaaaatatagtatattttccatgtgaaaacatatttccagaccaatttcaaaagaatgatagcttagattcctctctgctgcagtaagctatatcccccacttgaaatacatcccacctttcctataattacctcttccaccagaattgcaattatacatttcttttaatcttttacttttcaaaaataatggaaatttaaattgggaattaagttgcatttaatttccagtttcgcattttaatctttgaaaatagcctagccacaggcaaggtgcagctgaaagcttcaatgacagcacacctaaaatgggaggcctgtcagatttgacatatgaagtggtggtttggcttccagcaaagctttgtccattatgctccctctcttgttcacctctccctctagcttttcttccactgtcagagagctgaaatgcgaataattctactccaggaaacatatttcacataatttctataacaccaaatgaaaagcctttagactatattatcatagaagctagtccttatttaacaccagattttattggatatgtaattttatatacatattgtattacatacctctacctaaatacagaaatactttacagccttattatgtgtaataaaaaaatctaacatcttctcaagccacattgcagatggtagtattatctggatggtgcctcatgaacaaacttcaaaaggaaatgttgatgtgagaagattcctatggttctggtaagactctacatccccctccccccaggtctgtggaataatgtataggcatataaacagtacatacatggcatcaattgttataaccatatatatgtgtgtgcgtgtttaaattgtattaataagatttttttatacactcagcacctaacagtgtctaacacattttatatcttccaataaatgaatgaagcaaatgaaaacatcagtaaacagaaaaaaacaggcattttattcagtttactttaatttgagtggtgtttggttgtaatatctgacaaaagttagtgctatttaatggtttaaaataatttaatgtgtagttttcccctttaagttttgccctgtatcttttgctatggtctgtcagctataatttgttcaatcttttgtgtagctttcttcccagtcttacaagtctaattggggaaagtaagggaattaacaatgatcaaaagtctattctttttctaaacattcacatatctttgaatctctacaggaatcctggaaaagaggatcattttgcagaaaaaaaacataggctagagtttctgaacaccttgtcccaaaggtacagccagagtttgaatccaagtcagtctaattccaaacatagatcttttcctcaaaccataacattttcaagaactgtattttatcatttcttatgatccctgccaacttactcacaatattatcagtagcctagacattcactaaatgccaactgtgaacaagtgaagcctttaagacttggatggtgttgaagttccctggtgtgatatttcagtttactcagtacccacctgaatgaatgctttgaagaaaataaacaagtgaagcttaatcagctaagtaaatgtttggataaaaaaatgaagcttgtttaaataagggaaagcccttattcttctctgatctactcatttaagtcaaacaattaccataaagctaattctcaaaattatgttttctttaattattgaattgggttagtactgtcctttgacccattagtccaaatacacacatgcacagctacacaaatatatatatatatataaatatatatatatatatatgtatgtatacatagagagaatctaaaaaatactctaactgacaagatggagatgacactaatttatgcatatatcagggcaatttcaatttctgcattttaatagcttatctctgatatttgcaaactaagagcttcatttacagactgtacttgtatcatgagttcccaaactacaactacaaatgtttaaatatctttttaaactgagtgtgcatgaatgttttttatcagaagcattatttaaaataattactattatcttttaagtagcatcaggctgttggaatttgctaggaactaccaacaaataccttctcttaaagatactgatcagggaactccaaacattcttgcttctgtatcccctaaaaagactcttgaaaaatgagtcaacccttgcagatttaaaatccgcattcgaaatgtacttttcattcttaaatgactgaaaataatataatttgagggacattgtaaatatcgatatcttaaaactaagatatatgtttatgcctgaaaaaatcttattgatcacctagtatacttttcttaaacagtatgtatacacaatgagtgttttttttctgttactgtaagtcctaaatgtaaaaaacaaaccttttcaattgaggtattgttacaattattaacgtgcaattgaccaaaacaatatatgtatattataaaatttgataaacataaaaataaaattttattgaaaatacatctcttaataagatggatgggtatttaacaatttatacaccttcagaagaatataaattaattctacaattggaaaggcttcagcatcaattctatccctaatttttgtctgtatagatgtaaatgatgaaaaatcttattcaaataggtgagtagaaagaaacggaaggaattgtattatagtagcattgcttaatcatttgtgctcctgctatggcatatgctaaaagtacatgatgattgcttaccaaaacgtatttttaatgatctatcggctgacaacttatcaggtcttctcttcgggttcagttgaaagcaaagagttagcaaccactcttcttgcaaaaagctatgttgccctgtcatgaaagtcattcatgcttcttttgtttgaagccttagtaagatcagagttggatgaaatataaggctttttttcttaaattgggagaagtggttagaaaaggcaagtggttagaaaggagaaacagcctgaggtcttgactacagatgtcttttttttttttttttttttttcaggcaattcagttttcaggaagagtacaaaataaagtagaagatctagaaataaattcccttaaaactatctgtgcctactccttggaatgccttcatgtactcccaggttactccactgtgaggacagctgttttaagaaatttcgaatcattacctgtgacaagaaatataaactggcacatcagaatctcctgataacttgtgtgtccacttcctcagttgtacctcacagctaaatagttatctgttaaaccaagagaagttgcagttctgggggcaatagccttattggtatttgtgcctgaatataattctgaactccctcttttctaccttctaggctttgagttcatttatttcagcagcaaaagatgtcaggagcaagaggcagtcccacatagtgtagattcattgaatgagggagccaaacagtgatttagaaacaacattgccagtaactatctgattagccttaggcaagtttctcaaccttcctgaatctgtttcttcacaataactcccagtctggctgcaccttcgactcacacaaagatctttaaagagatactgttgtccaagcatcgcccccaggaatatggatttgattctctgcttaattctaaagtgaaggcaaaacaggaaaagtcaaagttagaatcattatccatatagtctttcaaaaaatatataataagtgcctatcatgagcagtgttgcaagttttctgtgttaaaatatctacaaattatacttctaaagaaaaattgaatgctacttgaatacaataaatgatacatttgagcttatcagtcttgaaaatcctttgttcaaaaacgatgcaaagtagagagggcaatttagtctacaaaaacttttatttaaaaaaactgaataaatagcacagacacatccaaaaagtgtatagcatggaaaaattcaataatgtatagcacagagacacccccaaatttgtgttgtttatcatgttgcatcatggtcttaattccacatttcatgtagcagaatgtatcccttcattttgagatccagaaggacaaaagggttgcacagttcccctttttctgcctctcggagatcttaaaaatgaatgataaacaattaattctacccaggataccaatgaaaatctattttcttttctttttcccaaacaaaaacctcagaaggcaagtaaactgaccttttaaatgaacaagatctgacatgattgagctaacccaagaaagaaaattcccctctgaagtgaataattttttaattaaaaggtgaaatctgacacatcacactggttttgttattattgttgttttcttccattaatctcacactcgtaagaaaaaaaatgagtgtattatatatgactgtgttttatagatgcatatattctactctatccatttcagtccatcttttcttaatgcatttgtcctgtcacttttactcactgtaattcaattttgttaggaaatgtaactcgctgttttatgctttatatatttcacctgatgcaaaatggactacctgattgattctgcatttttagtccacctttgaatttatagataaagatcaacaattaactttaagcattatgctaaaaaaatcttagccagaaggattgcttcctgaaaatgatttaatttgtatttttcttaaatataataaaatgccctgataagaagtaatcaacaattttgattctagttttccatttgatttgaacatgtacattatttcagcatggtggatgatacatatctacagcttgaaatatgtgcattggggaggttttgttgaatgctagattgctgttttgctgtagtttgatttatttgtgtgagttattagcttgatattggaaagtaactaaaatttgaatatatgatatctctgcttctgaaataaatatagcgattgaaaatggaccttttatgaacgttgagtggggcaatttctggcaggtggggaagagagtaaagaagattcattgtatgaaagcaaagcaaatacacatagaacttgtaatttaacggaacatatcagcagatgtggttctcagaatgactcttacatttacattaatgactatctaaaaagaattagacagcaccgtgaacttcctttttcaaaattaaaagttttttttaaaataaagaagttcagattttagcatcaactgaccaaagcataaggggccatccaagaaaaaaaataatctgaagcactttcataaaacgatgttacaaatcaatattttagacactttgaagatcatctccttgcttttcaaccttcacacttccgagacaggggatatatatgtttatatcatctctttttctaaaataaatcatttctgattgagcatcttttacagaagagcccactgcaaatgtcaatttttataattgcccagaccatacttgtgggaaaaatgaagggacaagagtaggaaggtcattcagggtcactgaatacatttctaccacaggaaagcattacgtcttttgcactttatttcttcaagccattcccttccaacatctcatatccctgtccccccagaaagttggagtcacaggtgacacagctgggaaaactttctttatgaaaagattaacacatgttttaaaaagagatacatatgtatgtcaaaattattccagaacactgttctcagaagggcagtaactgcaaccaagttagtttctgctattgaaacaaaatgtgaagctcatggggaaatttcatcacaatatgctgtctatgaattaaaaatccatttaatataaagcctccaagaaacaaagaaaacttgttttttatttttacagaagacaacgtacaactttttaacccctaacctaattttttaaaccaaaaccagaattattttttttttctttttagctttcaatgaagcacaatcaaattcctggagaaaagatgggaaaacggcataaaacaaagcacgaacacggtatttaaatccaagtttgccacaaaatgtaaatgtatttcagtaaatgttctataggatttgtaaacaattgaaaagctgttatttcttttacaactgcaacataataaacattataataatatacctttctggtaatgatatagaattttttatctggtgacaaatagttctgccaaaagacagataaagtaaatcaaatgcaggcgtaacatctatattatgtagatgtgtgtagttattactagtggagattaatatgatttattatgcttataggtcatttgtttgacctttatagtaaaatgccatttcatatccttcttacatattgttattattaacctccattagtcatatatttttgtaaataccttctctaaatccattatatattttaaaacttggtttatgatttattttgctctatggaagctttaaactatcagttaattcagtctgccaattttatgttttaagtcttccaggcttcctgacttaccaaaaatctgtctcccatgaagcttataaagtcctacactttcctttattgtttatatgaatttatatttctagttagctccttaatctagtagggcgtttttttggtctatagttaaacttataggtacatgaatagtcaattacgagacactatttattaagtgaaataggctatccacacagaactaaaatatccaatcttatttggatgttttcctggactctcacttgtaaaccactaacccatttctctagccttatgccagcacactgtggttttgatcacaattacttcaaagtatagtagaaatctggaagtgtatgttgctgccataatatgcttattaataaaattgtttccaatttatacacacacatacacgcacacaatttccttctatataaactttaaattacatcattgcctatttcctttgaaattatattgcccccaaacacatcaaaagcattctgattataactgtattaaattcaaatgttaacttggctggtattgcaagtttaatgacaataaatcttaaatcctaaaacaatcctacgtagtcaatttttgctttttcttatgtatatttttatgcttttcacctatagggtctacaatttttattcctccttaatttatacattgtcatcagtgtgaatgaaatatttccatttgcatttatagtcattaatatgaataaaagctattatgtatctattcataaagtatttttaaaattatttcacagattttaaaattgagtctcctaggttttctctgcacaataatcctatttaacaataatttttcttctttaaaaatatttcttctttccttttgaggttatcattactattattattttagaggtggaggtcttgctacttttgacttatttcatgagctagaccaagcaaagcaaatttgaaaactttgaaaaataaaaatttgataatttttaacgttgacaatggtgcttctttactagggtgtcagcaaactacaaaaaaaaaaaaaacaactttgttttgcaaactttgtatttataaaattttattgaaagcacaggcacacctactaatttaagtattgtccatagctgcttccaatgccacaactgcagaatcaagtaaatgtgacagagactatttgggccacaaaacttaaaatatttactatctgccccattacagaagaaaaaatgcagatttctctttatccttctccttccttttactacgcagcaggcatacttctaggatttttttttttttcctatataaccacatattatttccgcaaagttattaggaagtacatgggactttccagccccatttcacattggataaaactgaggcatgaataagctaagtcacctgccaaaggtcacgtgggtggcaaatatcttcagcaaaattttgaccccaaaagcctaactatgagttcataactgtgcagtagaaccctttcatctttggtcccatagcacttatcatactgtattgttttgttacattttttttattatactttaagttctagggtacatgtgcacaacatgcaggcttgttacatatgtatacatgtgtaatagactgtagctatatgtaaacataccagctttcttagatgttacttcctcataaagacctccccctagaccagtgattttcaactagggatgattttgctccccaagggacatttggaaatgtctgggacaaatttgtgattaaagaagagagtactattggcatctaatgggcagaggtcagttgtgatgccaaacatcctatagtggacagggcagtccaccacaacaaagatgtatttggctcaaaacgtcagagattgagaaacattgccgtagatcaattgtcatcttctgaactttgacgtttacacatgcaactaattgtacaattatttaacatctgtacacccattcactgctttcaccactagactgaaaaactccatcagagaccacatatgttttgtgcaatgctataccgcctgtgccttccgcaataagtgacacagcagacactcattaagtataagcttagtgagtgaatagtggataacttaaagttttatagtgtatacatgggacttgtcaagagtctctgtgtttcataaacattgtcgtcatattctagctaaccatatttaaaattttatatatatatatatatatatatatatatatatatttcaccacaagatttttatggtggtgcttttatccacagttataagttctttaagagatattttctatcattaaaaaataaatttatgcctatttactgaagtatttgtgaaaaaagcccaactgacgagtaggttagaacattcgaaatcttcaggttttgatagttttgttttacatccgtgttaaagatgttttaactggctcttcaacattctctaagtaggtagggctggctctaggcaagcacctgaagtatagagttagcttcaggtctgccttccttttcttacctttaggatttcctggtatctttatcctatttctcccaatcccatcttctgctctgtacctctcttgttgggaaataagactcagaatcacagactcttagaacacaacaggactttaaggccacctctcctaatcacccaactgataaacaaattcccatgtataactcccaggtcccaatttttcattatcttgcctatgatcaggtatcataagtgctagaaaacacactattaattgaggcaccagttcctgcttttgaaagttctgatatttagatggctttttgttgagtcaaatgtcaccccccactttagcttctatcgagagactgtgtacctcttggaattattcagcacaagtttaaatttttgtgtccgtaacagtccttcaaacatttgaagacaactatcatctctcttcttctccctgctaaacttccctagatctttcattacctagatgacacagcgtcgaggcttctcaatgtatgaacaactaactaacttccaacttttctctgactggtttaaaatctcttgtaagatttgactgtttattcattacatgaaggaacagcgagaataaggggataatggttccctctgttctctcctcaatgcatatttgttgtatactctttgccaggagctatgctaggtcccgggaacacgattttgggcaaaatagacagattcctttccctcttgctgcttataatacaattgtccctcagtatccatgggggattggttccaggatccccacggatagcaaatccacaaatgttcaagtgacatataaaatgacatactatttccatacaacctacacacatcctcctatatactttaaaacatctctagattacttataatacttaatacaatgtaaatgctatataaatacttattacattgtactgtttagggaataatgacaagaaaaacacctataaatcatcagtacagaggtaggcattcattgtttttctgaatatttttgatgcatggttgcattcacagatttgtaatccaagaatatgaagagcccctgtaccaggtaagagggacattgatggaaacattacagttaaaactgaggttacaaatacgacaagtgttgcctgaaactatgagagcatataataagggggcctatatttaaaagtaacatctcacataatcctcacaatgacccaaacatgcattttcaccttaaatatcaggaagcaaaattgcacaggtattcttaacatggatgccgggtctgggcctcaagaagaatccctggttccttcactctatgagggaggtatgatacccaagactcaaagccaagtatgcatagtcttaactcatagttccttctgacaccatgctttctaccacaggctaggattcaaagtcagccataaagatccagaaatgagtaaaacatacatctagttaaggggagaaggcttaattgctctctaggttgccaatatgaaatgaaaaagaatggctaaccacatctctcagcattgtcaaaatagccaatgaacagagagagcactgcaaagacccccaactcaattcagacttcatttctacctatgtggaattgctgcagccagaaatttaagtaaatgttacttaaatgtaagagccatgtacctaactcttaagtggatatcctcaaatgcaaatatccatttaaaatatacaagaattactgtgatataaagtaacaattgctatgtatcttttacttttgtcgcccagtggcctttagactctggatatatgttaactggcatggctactttggaatatttactcatatatgtaaaccataatggccttaaggactacagataaggcttctttcatattaatcaactatctttcaaaatgtgtaccgcaggctgttctcggaatggagctagatttcagccattagcaaaggtctacaaagtaaaatcactgttactgttaacttttatttttctgattaaacatggatatcatttggatatgtgtccccgcccaaatctcatcttgaaatgtaattcccagtgttggaggtggggcctggtgggaggtgactggatcatgtgtgtggatttctcatgaatggtttaacaccatcctcttggtgccatcctcatgatgatgagtgagttctctgagatctggctgtttacacgtgtgtggtacttcattctgtctctcttgctcctgctctagccaggtgaagtgcctgctcccgttctgccttctgccacgactggaagcttcccgaagcctccacagaaggagatgctgctatgcttccggtacagcctgcagaactgtgagccaagtaagtgtcttttctcatccattacccagtctcaggtatttctttatagcaatgcaagaaaagattaatataacacaacacacagacacatgaataaactcataatacactaattaaaacaatattttgaacattaagaaaacatgcccatgtaattttatgaatgtctttcgtatatcctttcagggattggacgttcattctaacatacctcttatatattgtgcattaatttaaaaaataaaggctttatggcttcacctctgcctgtgtattgatggtgcttttagtgtttcacctttgctgttctgctaacatatcctcaataaatcgatcccaagtgccagaaagcaaataaccctttattttttgcacatttagaatgtttcccccaaaaaggagggagacggtaggtattagagagtgcctactgcgtggtgttcaatcacaataggcccttcgattaatatttattcattttgacatcccaacttgttctagtctgtgatggggtctttaacctggcatctgtggatgggattaagggaggtcccaggatcgcaggaattatattacataaggtaaatacctttgcgttgtgagtcaggtgttacattccatttcacagtggaagattattgagatccagcaacatacccacatcattgataattggtagacatggggttgtataccagctctgtgttactctaaaacacatgcttgcttcaacatgccacactgccttcttacagagctgtgaagaagttgaaatcgcgaaagctattaaagatcaaggcagataaacttcatattatgcagccttcttgtgagtataactttcaattatctccaataaccttaactacatacaaaactatcatacatcaatgatggatacagaattaatctcatttgaatcaaatctttaaaagaatttcaactgttgatataattttgaaaacaaacttttttcagttgaggcataatttgcatataataaagtgcaaaagtctaagtgtttggatggatgtgttttgacaattgaatgtatctatgtattcaccacctgaacaaaatagacaacatttccattaccccgaaaaagtcactaatgcctctgtccactcaattccaaccctcacccagaggtaaccactttcttaattctattaccgtaattgagttttgctgtgctttaacttcatgtaaatacccatatttgtgtctatgacttttggctcagcataatatttttgacattcattcattcatatggttgcttttaccattggtttttcctctattcactgccgagtaaaattccattcatggtttaacagaggcatcaactttttgtgaggtagtgagggaaggaggagggaatgactgcatttcatgtgatacgtaaatggaaagaagcacctagctacacaaagagaaaaggaagagcattctgggtctaagaacagagaaacacgtgcaaaggccctgagatgttttagaaagtgaggaagcactaatatgattatcctatatggattgagaaaggttgacttaagaagaaaatggtaaagatagaaatataatatattcattatgtgttgtaattcattgtattctaagccataataaagagttgggtgttcatcctaataagataaatccatgagggccttaagcacagaaatgcctttatctagctgacattttgagaagatccattttgctgcggtgtaggattgaataggaagagaataacaacagtagtaagagaatgtgacctaatctggcaagagggcagaggtgacctggcctaagatgggggagatgcagaggaagagaaggcaaattcaaaataaatttttggagacagaagttgcattgcattacttgcttatagattagatataaaatgggagataaatgatggaatcatgtggactctgcttaccaatcaagtagataagaagaagatactactgtgaaatagatgagggctggggaaggggaaagattttaaataaaatgtcaaagctgcatgtgcggcagccaatgaattgtgtcatatgctcaggtgaacaagcaggtttggaatcaagagaaatatgggatggaaagatagaggagttattcaactaaagatggcagttaagtccgtagaaatggatgctatcacctaggaggagagcgaaaccagaaaccctaggattgaaggtatagtctcaaactgtgacatacctacctccgaggaatttggaacaactcactgggacacaaaagaaaactgtgaatgcttctatttgtgtttgcatttatatttattgatttctattttcacatacgtttacatgcttagtcatattcatatatgatttacaaataaatgtacattttgtgggaagaaatgtgcttataagttttgtttcaattagaaagcagtcttgaaattttgaagagcattgccttagaggtcaagaggcggaggaggagctagcagaaacagctgaaaagaagccagtgagcttcaacagaagttattgtttcaagaagaaagggagtattctgttgttccctctttctatctgtgcagttgtgggaaatgtgaactcatagtttgtctcgtgtggtcctgttccaaatgccatacttgctggaaatagagtgcagagcatccataaaacagtctataagactaagcatatataaggctgccaaagaagtcatttgttactatctatcttcccattcattttctcaagtctagttcttctgctggcctgtggttagggggtttattctgagtatttccctgtgtctttaaaacttcacatttatatttgatggtattccatgaaatcatcaggttacttgtcaggtttcaaatattacatgaactattttggaaaaaaatgtacatttcaggctcatttccagtcctaaacaatataaattatagccaagtatggcatttagccattaatgctgtctttcacttcagtaatgtaaagaaataataggcttatgacaacttggataatacatttaagcttctacattattgctccagatataaaaaaaatttttcacttcacagaggttctaccttgaagaaagaaaaccaggctccagatataagcctgaaactttcctgagtttctgacttttgccagccatttcatcacactaacaacataaaccttaaatagttaaaacaaatgtaaggcatttatgttatatattcaaatggatataccatggaaaaaaagaacctattactgaatatttagtttgcttcaggcttcgcaatcattatagattccacatttaatatatatatgtgctgattgagttgtcttcattatttcttataaaatatctccaatgttcaatctattgatcatgttgaaagaaaaagggtttagatgagctgtacacatacatatatactctcgggatcatgataaaacaagacaggtggcctggcacggtggctcacgcctgtaatcccagcactttgggaggccaaggtgggcagatcacgaggtcaggagatcgagaccatcctggctaacacggtgaaaccccgtctctactaaaaatacaaaaaaattagcggggcgtggtagccagcgcctgtagtaccagctactcgggaggctgaggcaggagaatggcgtaaacccgggaggcagagcttgcagtgagccaagatcgcgccactgtactccagcctggggtgacagagcgagactccatctcaaaaaaaaaaaaaaaaaaacaaaaacaaaagaaaaaacaagacaggtgactttgaattttaatgaacaagttagaaccctcccccaacatctggttttaaatgctattactttcggtatgtattgcttatcttaataagtatgatgagcttaaatattagcttatcttcgggtccctctcttttttattttaatttttgtgggtacatcgtaggagtatatatttgtagggtacatgagatgttttgacacaggcaggcaatgggtaataatcacatcatggagaacggggtatccatcccttcaagcatttctcctttgtgttacaaacaatccaatcacactcctttagttatttttaaatgtacaagtaactcattattaaccataatcatcccgttgtttgatcagatcaaatagtgtgtcttattttccctgtagaattatttggaaattttctgtttatgttttcatgagctttgggatttggggaagaatttcagcatttttgacttaagatatagttggttcacttagcccagcagtgaacttcagggggtcaatagcatgcaaatatgtatttaaatattaaacatttttgtttctgttaacatcaaaaatttattggacatttaatcttttaacagaaaatatctcatggtttcatatgaaaagtggatgttcttcacattttatttatttcaaataatttacatttatttttacttattggaattggaaaatataagttgtatatatcacgtattatacaacacattgtattgaaaaatgtggactagctaaaatgagctaattaacatatgcattacctcacatactatttttttgcggtgagaacacttaaaatcgactctcttagtaattttcgaaaacatattattattaattatagtcactatgtcgtacaaaagatctcatgaacttatgtctcctatctaactgaaattttgtatcctctgaccaacacagcccttttgtatcctttgattttaaaaaaggcgttgtttaattttaacagtgtcaagacttttaatgataccaggtcctgaaaatgtcagactgtgtttcccatacagtttctttagcatgaaaggggatgtatgcatttgaaatatagtagttgatgaacatcttttagatttttcagtagaattaaaactggatgataaaaattcagcacatatcaactatattccaaaaatcaataaaagtgcctaggagaaacatttaaaaggttaaggaaattaagaaaatggataagataataagataatttaagaaaaattatccaaaacttagaagtaaaacaaaagatgatcgtgtgtgtttcaaaataatggtagcgttgttttctaacaaactcctcacaccctcacaagagcttcaatattttcagagtaaagcaactcttactgtttactattaatttgggcccacacatgttacaacgctatgaagttcaatgcaaattttagaaaactgatatgatgtaaatgactttttacccagtagaggatataaccccaaaggctgtagggtatcaacgagtttagtatcttattcactaatcttattccagaatacttttttaaaaattcactcattatagaagcatttgtttcttgtattctcttttgaaccagttttgtcttcctaccagctctccaattactgtattaaataaaacctaccgtgagttcactatgatttacatgaaaattatgtttcttcataaaatttcactgtgctgataggtggtagaattatgaattttctttgtacttttctccattattcaaaatgtccccagtatactctgaacaaaattaaacatttaattggaaaaaatacatgctatatgcaaatctatttagcttcgtgttgccttaggtatgcaagacgttacatatcatacaaaaaaaatctaagccaccaaagataaaacagttttgcaatcaatagtgtttttccttttctcttccatcagcagcacagcgatgtacaataaggaaataaagtaaactttagaaatatgaaatgtgtatacgtattgacgtgcttattgtgaatgcgatgagaaaggcaagtcaggacagtgagagtcaggttcattacactgcattctcacactataaatgaaagagtagcaagtattggctaaaattcaataacttccatggccaagatacctactataatttgaacattgattccctttgagaagctttctcctgaggcaccatcaagacagatattaataattagtagttcagctaggggttggaccacaaatatcaacctgaacaaactacagaacaccctccacatttgcttcagcactgacagttttgaacactccctggtggccaaactcacttgttttcacctttgaaatgagttagttttcactgagtgctgttgggtactgagccactagcagaagtgaggatgtgcagtctgatgactcacggttgcacgccactaaatactgccaattacacacatttttccccttgcaaattttggggaagggggaggggtgtgaagggggaggggtgtgaaggaggaggggtgtgagcagctgcatataaggagtgcctatactttctttcttttcttttttttttgagacagtcttactctgtcacccaggtcggagtgcagtggtgctatctcagctcactgcaacctctgtctcccaggttcaagcaatcttcccgcctcagcctcctgagtagctgggactatcagcaagcgccaccacgcaaggcttttgtgtgtgtgtgtgtgtgtgtgtgtgtgtgtgtgtgtgtgtgtgtgtatttttagtagaggtggagtttcaccctgtaggccaggctagactcaaacttctgggctcaagcaatactctcgccccagcttcccaaagtgctgggattacaggcttgaaccaccatgcttggccaggagcacctatagtttctacctcaaaaacatagccccctatacctttccacagattatattgttacttttgatattgaacttcttttcattgtaaaagcctggagaaaatttaaggctgtttatatatctgttttctaaatcagcacaccaactgtgaactctgcacttttgaattgggatgagagaatggaaagaaaaaaggttgggagaggagcggagctgggaagaaaggtgatctctagtcctttttcctccgctccctgctccagctcacttttccaatcagtttttataataagcattatttattctcctacaaaagtctcaaagtttactagttataaaaaactcatgatgctttattaaatagggtaaatttgactttgtaaagcaaaaataacaaaatacgtaatttgtaattttcaaaatatacacatgtaatttgaaattacatgtaatttcatattatgcatgtgtgtaatgcaagcacacatgtaacaatacatatgtaacgtgttatatatgtaacacgttacatatgtgttgcatacatatgcacgtgttaggtaacgtgttttacatgtcacatgtaacaatcaatttcacatgtaacatcagttacatatgtgaaaacacacatatgtaatcacacacatatataatttgaaatttttcatagccacatttttaaaagcaaaatgaagtcaatttaattatatattttatttaatcaactataataaaaccataattttaacatgcaataaatgagcatttacttcctttttggttctaagtattcaaaccctggcatgtgtgttatactcagtgcccatctcaattagtactagccgcattttaagagctcagtatcttatgtggctagggggcactgaattggactttgcagctctaaagagagacctcacattgtgatttttattgtcaggcaaatttcaaaattatttctctgcttggatgaggcaccacgtctcactccttgcaaatacatcactctcactaccaaatcctggattagttcagtgttgatgtcatattgttatgagctcacaacacctgtagcattcacacaaataggatacagtggtttaccccttatctgtaggggatacattccaagactcccagtggatgtctgaaactgcagatagtactgagccctatataaactatatgtacttgtgataaattttaatttataaatttggcgcagttaagagattaaaaatcatgaataaaaatagaacaattataacaatacattgtaatgaaaatcatgtgaatgtgatctttctttctctctcttaaaatatcttattgtattgtagtcacctattttcagacagcagttgaccatgggtcactgaaactggggaaagcaaaactgtggatattttgttccaccactgtggagatgtacattatgactacatcattaccaccatctgtggttttcctttaagggtgagactatttatatgcaaattcaaacaccccccccccccccaacaaggaggccatatttagattacctcctggaaagttacttaactctctggaatttgaatttaaataaagagtagacttcttatttcattttgggttttgagaactatatcaagagctcaatatcctgtgaatgaaatactgatcatgcaaacacagccaaagattgtctagggaaaatgctgaagggaactttccaaatccactatagttcttctttcttaccattccatttatgggctgtccacttactccctggcatctgtcctgtgcccctttctgattgtaagtacagtcaacaatgatacaggcaaagtcattcgcttatctgtttctttaagactccagtgcaatgatacaattagacttccaaattctcataagtcaaaaggtacaaatccctgaaaactgctgaatgagtattgaagtgttggcagttacagcttatgatagaatttttattttcaaaagagaaatttaattcagggatatcactatacgtatatccttttatttcctttttgggaactctataagaagccatacttgtttcattgctggatctcttatttcctggaataatacttgtcacacagtaggtcaacaaatatttggttaatttatgtattgagagaattgcttggcacaattcaaccctctcaaagtttatgcaggtgagcaccgtgcagtatagtctcctttggcagcaagagcttaatatctgattttgagagagctgagaatgatacgcaaaacagcattagtttcttccctatatttttaattacagtaatgctgtcttttaaaataagactcctgagtactttatgatcataataaatccatcttaatcgcattcactgctttattttcttttttatttcttttgagacagagtctcactctgtcgccaggctggagtgcagtggcacgatcttggctcactgcgacctccgcctctcgggttcaagcgatactcctgcctcagcctcccaagtagctgggactctaggcatgcaccaccacgcctggctaattttcatatttttagtagagatggggtttcgccatgttggccaggatggtctcgatttcttgacctagtgatctgcctgcctcggcctcccaaagtgctgggattacaggcgtgagccaccgcacccagcccactgctttattttcaagcagaaaacatacacaacaccttcagatggatgctaaagtagaaataaactgtttaaaaatgattgtcatgtggtatgtctgagaagaaaataagcatcacaggatcacaaaatctgttaaatatctgtctccaatcatgacttgaagttgcactctttcaagtatgctaaactgcagttttcctttaaagttcaaaccgtaattataatgtaaaaacccaggaagtatacagcaaaccgtaagtatcctaaacaaacttaaatcttgaaaagtgcaaatctcatccccaaaagcctttgctcaaacacattctgcaactgtggtttataggctaaaacacagacttgtctgtgtaccgtgtaatgtcctttgcaaagttttcctaacctacctgtctggcccatgctatcaccctccatctggaggcctgggatcccaaagcttttgccacttaatattggttgccattctccaagctggcttttccagactgaggtcatctcttctgtttctataaaacttttaaaatacagttattatggaaatttaaaactattatgctatatcataactttgaggtttatgtatctatctctccctgcactagactggctttcttgagtgctggaaatatgattgattccttattccctcacataaaggcaggcatctgcctccctgactgaggtagggtcactgcacaagtagtattgttttcctcaatgttgaaacttttggtctgcagcactgtcctgaaacttaagaaaactatgttgaatgagccaaagaaggctgatattcagggaacagtaaattttaaggaaaagcagttttgcctgtagggaaccatgtcttatggtgggcttttctcttgagggtattctgaaagggaggcaattactaaatccttggctatgatcttcaaagggcttctgccctgtggaaaccaagaggctttcttagagaccatcagcccttgccatacacaatccaatgctcatgtcctccatttgacagccgcttgctaaattcctccgtcacctcagtaacctatgtcttagagtgatatagaatccgccaaatctatatatcaaacagagattaccatgagagtaacaatgtaattgaaggcacttcttaaattatgaagtgctttgttatgttatgactactgttattatcatcaacaaccctaacatcatctctaataacaactccttttaacatccttcttttaatacactatgggtcaaattataattatattaataaatatgttatgtctcaactttactgatgacaatataaaataagtttaattagagctctactcataactaaataacatttttatgaataaaagaagtttcatcttcatcacttaatatatttaaggtctcttaggaagaccttgtcctgtagtcagtggtattattctttttattagtttcctcaagatttattaggcagagcagtgacttaatgtttttggcttaacatttctaacttctagctgatgaacagtaaaaaaaatatggtgtttgaatcccagattcttcatttattagctttatgatttgggataaagcgtttaaactttccgaaatttttgtctaagagttataagaataccttttctacctatcttgctgggagtatttcaaaatcacatgaagtcatattcttggtaatttttaaaacagcatgcaaaagcaaggcactaaaccaactttataaattactgcaatgaaataaatcttgtattacatctttctgtgtatattcttgtaaagttgattttgtactattttccaaaagtattagttttctgaactggcttcttaattttctaaaacttatacttccttacactcaccatattacaaccttgtgacactcaaccagaaatcacccaacacacacatacacatacaactgtgttagtcccttcttgcattgctataaagaaatacctgaaactgggtgctttaaaaagaaaaggggttttcttttgacttacggttctgcaggctgtacaggaagcatgtcactggcatctacttctggtgagagcctcaggaagtttacaaccaaccatggtggaaggcaaaggggagagcaggaaacaggtgggggttgaggtctcatactcttttaaacaaccacatatagcatgaactaacttgtcaccaaagggatcattcatgaaggatccacccacatgatccaatcacacctaccaggccctgcctccaacattggaaatcacatttcaatataagattcggaggtgataaacatccaagccatctctctctctctctctctctctctctctcacatacacacacacacacacacacacacacacacacccacacacacacagtcgcaattaaaacaaaaaatctgtgaaacatctatttgtgatgaatgctgatattttctattttgtttcactaaaaatcaaaggccggtgttgatccacaaactgagtttatgattcacagtttggacaatgaacactagcatactagatttaaaaaatgaaattaaccaaaacaaaaccaacaataaaataaaaaatgtcctcagcattattttgtgccatttctttccatgcatccaacacgcttaccaagagttcctctcatcttgtcattatcataccacaagtttttctgacaccatcacttttcaactttttctcattttcatggatttacaattctctcccttattttcatatcgctctctctatgaagctttcccaattcttctggctagttactctttgggttgcctctgctctgactcatcaatggtgtaccgacctctattatatctattagatgctatttttatggcttaaatgtccatttgctaattataccacttaaatgtttcaattgtttaaatgtccatcaatttcagcaaaccttggattatatgtgaataggttaggattgtatcaatttcaatatcctgagcacctagcatagagcctgacacagagcagctccaaaagtaaaagttttctgaataaatgtgttgatgttaaaggttaggtgaaatgtagagaagtgtcaaagtacacaagatgttcaggttttctaagataaaggtaatctccctggtgtgattctgtcctgcacagctgttctcttgagcagtggtcctttatcatcatctgccttctctcccacctaagtgcgtcctgccacctgatggacgatgatggacatgagtcctctgaggccccaaaactatctttttggttgtgaactaaaggccgacaaagatgatcactttaaggtggataataatgaaattgagcaacagttatctttaagaacggtcagtttaggggctggggcaaaggataaattgcacattgttgaagcagaggcaatgagttacaaaggcagtccaattaaagtaacactggcagctttgaaaatgtctgtacagcccatggtttcccttgagggctttgaaataacaccatcagtggtcttacggttgaagtgtggttcagggccagtgcatgtgagtggacagcatttagtagctggggaggaagatacagagtcagaagacgaacaggaggaggatgtgaaactcataagtatatctggaaagcgatctgctcctggaggtggtagcaaggttccacagaaaaaagtaaaacttgctgctgatgaagatgatgattttgatgatgatgatgattttgatgatgaggaaactgaagaaaaagcgccagtgaagaaatctatatgagatactccagccaaaaatgcacaaaagtcaaatcggaatggaaaagactcaaaaccgtcaacaccaagatcaaaaggacaagaatccttcaaaacaaggaaaaactcctaaaacacccaaaggacctagttctgtagaagacattaaagcaaaaatgcaagcaagtatagaaaaaggtggttctcttcctaaagtggaagccaagttcatgaattatgtgaagaattgcttccagatgactgaccagaggctattcaagatctctggcagtggaggaagtctctctaagaaaatagtttaaacaatttgttaaaaattttccatctgatttcgtttctgtaacagttgatatctggctgtcgttttgataatgcagagtgagaaccttccctaccatgtttgataaatgttgtccagattccattgccaagaatgtgttgtccaaaatgcctgtttagtttttaaagatggaactccaccctttgcttggttttaaggatgtatggaatgttatgctaggacatagtagtagcagtggtcagacatggaaatggtgggtagacaaaagtatacatgtaaaataaaagtattttaataaagtaaaaaaaatgataaaggtaatcacattagaagattcatctcttgggtgcaacagctagggtagcctcccaagccctgtgtggtagtagtcagtatcactactatggtttcaatgtttttccctccaaaactgatgttgaaatttaattgccattgtgacagtattaaggggtgggagctttaggaggtgattaaggattgagggctccaccctcacgagtgggtttggttcccttataaaagtgggagttcagcccccttttgatctttcttgccctctaatcgtccatcatgtgatgacatatcaagtaggccctcgccagaggctgacaccttaatgttagacttcctagtctccagaactgtgagccaatacatttttgttcattacaaattattacctagtcttaggtactttgttacagcagcacaaaacgtattaagagagttacctacttatcttttctgaacatcattacaattccatttcaaaatttctgctcttaatgatatcccaaggagactagaaaatatttcaacagttcagccactcttcaatgaaattatcttgcgtggtcatgtactcgttaaattgccctgaccattctttgaaggatagcactggttatgagattaaatttgaaagttcctatgaactatcagttgagtgaatttgcttattatagcatatatcttaatcatatgttcataagcctccattaagccaggctgcacagtttatttttttaacaattgcattgttttaaagttacagttgtttcagcaatccattactagtatttaaaagtacacacattgtccttttgtaaatacatacaacagccataaattataaaaaaatagaaattcaaggataaaatgtttgaaaaatgtgttatttaagattagcagtaaaattggattttcaaataaatccatgttaactaggatttacaatacaagcctgtactatgagttgtaaagccaggattttgagaactatgctgccacattaaatttattcattttcacagcctgcagacattttaatgcctgagtagcaataagaacaaattaccaaaaaaacttttaatagggtataataaattaagactgaatggtaatgcaaacgtgggtacaacaggacaaaattatgaatctcatataatgacccaacaacacttagagtgtggaaacaacgttggtattctgggatatacgaccacggttaatcctaattgtttttcccttgtcaaatagaaattgcacatcaatctcaaagtattacaaactgttcattacatgcaaatggttatgttctgcaggctctccaaggggactcaaccttctttacaaaaggagccaggctagaagcagagtttctctaatgacagtaagtatccattagagttcctcatatataagcaagagagactgcctctgattcccaaagtcaggttttcccaagtcagactaggtatcccagaggtgtaatggaggactgtcaattagggggcaggaaaaataacagctggaaaaacaacccaccatttgtcctaggccagatccagtactttctggagtgtttacttactgccctttgctttagacgttgtgccttaagacgttgaactcatgagactgtgagctcataaagagaaaaggagctcttagtcagctctgtattcctagcagcaagcagtatctgctttgcacacagtaggatcacaatatatgtttgttacatgggttctggtatttaacatatgctccaatgggtaagagaacagggccatcatattgttaaagtatcaggcaatgtgaaaattttaagtgctctgtacacagaagaggtgaaggaagctcaatgtaagagagaatgttttggctatgaaaagcaaggacaaacttggggatcatttgtctcaggtaatacaataaaagtatcatttttaaatttatttatgtatttattcgttctactgaatattacattttcaatatatgaatcaatttttctacgtaccgaggtatattggtgatcgagaaagaccaagtacccaaaatatgttcattctaatggaaaagataataaacatgaaaacacatactacagtttcagcaagtgacagagttatgaagaaagttaagcagatctcccagaaagagttcaattttgtgtgtgtgcatgtgtgcgtacgtgtgtgctttctttaagatgggggagttacaaaaggcatatctgtgaatataaaattagagcacaaatatatataaagggaagtgtacaaaaattctgagagggagtagattgggacatggtgagaaactggagatagggtagagccctctggtagagagaaaagcaaatttaaaggtagaaacaagcattctagggaacagtaagaagggatgtgaaaagaaaacacgaagatcaatatggctggaacatcgtccttgcaaaatattatttcatgaaaattacttctattaactttaatcttacatttcattaaatgacaatttctgcttctcattgcttccagaatgatggtgcgcagttttgttttgattttttctatttggaatttgcaatcagcattcttctcattttttgtagtctcttactctcttgataatttcatgctctaagaatgggaatcccttagggatgacatgtttatcctgcattttaagcagttctttaccgtggttactacagtaagttatgtttttttgttcttgcttctttccaataatgtatgaaaatctgtcatcttcttaaacatgccatgctggacaacggaagtctaataacaagccactgaaattatccaattattttaatatacttatttctgaaagatacacttgatgggcaaggattgaaagcccctctcggaatttctgcctggtaccacactcccagtaaattggttatttactacttctgaaaagatggataggggccaaaaagttgcagaggagtttccaagcagcaataaaagggtaacaatatttacgcaaggatgaagtgcccaactgtttaactgtattaagagacttaactctcatgccactaccagctaataactttgaaaagctcattttaaaatgtattcccacacttacacattgctgtaaccttaaagtaagtgactagagacaaattctcttagcagtaaattttccggctgattcccttatgctagtgtatgtcttctagttacagaaaccaggatagctttgtgaccacaaaacaaaatcttatgaaattttattactgctggggaaatataaaggacaagcaatggtatgaattattcttaacgttagggtcccagtgaagggcaacagatggtagaaatatttactccagtgatttttccatcaaagtttctatcagcatttgaatctcagcagtgtggctgttaagaagccgtcaaactcagcagccagctggtgaaatcacaatgtaaaaactgactatacagaaaatatacttgtgtctgatttttttacatcatatgcctttttctagattatcctttaattcaatctgtattaatataaattcacttacctcctatagagttctttgaggcagtagattgccatgttaggtgtatcctaataaaaatacgaaaactcattctctgtagcagatactgtcagtgacctatgcacatctattcagcactcatcatttttgtacaagtcaatgacctttcaacggcagtacctgttagataagggctttctgggctgcgagtgctgaaagcaaggcgagaagaatgagaaaacctgggtatttccattaagaggaggacggtcttttcatggactcgcttgtctcaaacttttgagcaggagtcactccaactccattgtgctctctgaatctaaactcttcagaattgggtcctttaaaaagtgctttagaattttcttcaatcactaataaccatggtaaggtaaagctgaagagcagctaaagggagagctgaagagcagctaaacttggctttgacatttttgtactctttttttgccttctctcaactccaaagcaccagtgtgctctttctttctcccttttgttcctcatctgagagatcacagcagggtcaccatgctataactacatgctttatatgtaattttccattctctctggacatttcacatttgagaaaagggagtgtatttttcttcaatagaatatgacgttaaactataagtttttcaacatttgatggtgggaccatgtgaacattaaaatatgacatatgtaatccatatttacttctgtatgctcaatgacaatgaataaatttttactttcatatcacaaagtaaacagttttttattacatttctttacagcaacatatataaatatattgcacatttaccatataacataggttatggagcagtaaaacacactaacattgcaaaagataccagaaaaccaattagcttaaccttaacaagactatattttttccctaaaaacagcagtttattcatgtcagaataacacactggtgtttcgctccccatgtctgcttaacatttgttgatttaaagcctaaaaaatttcatctaaacaataccactactgttaatgtcttaaggtcgatttcaaatggaataccttaagattttagggtctcaggcttgtatgtctgcgacaacgttctgcaggaaatactggtcatttttaatatggttcattcagcagcattatttcataaaacagatgccatttccattaataaaaatattcagctggtttaaatacttaatctaatggtaattgttattgtttctactggcaactacaaacattttccatctcattctatcatagcccatgttttaaaacttattttttcctagtctccaagaacatgctagctttaaatgttagggcattttataatttctactttcctattttcactgaagggacttgaaagcacacaaattcaccctgtcaatatatgagctaacattatttgtgtcactttccttcatggtgttcagcttttcctttgaaaactcccattaacatttcttcttgttagctaggaaatgagtaggcagaagtgtcagctatctgaaacagatgcgtttggctgaattggaattttcctcaattcctaatccaagagcccttatgctttgagaagaaattatactacataaaaataaggttttatgaaatttccaggttggtttttctgcagtgtggatgtttagagacgataattcagtaaataagtcttagtttgtattgatatgaactaatcacttataaagagtgattagttataataggggcttacatttaatgagtaattattttgtgcaaaatgctattccaagtggctttatacacatctcatttatatttccattttagagaagagaaatcagagacatgaaaagaattaagatattttcacaagattctacaactattaagctaaaggacctgggatttgaatccaatctttctgagtccagcatttaaccacttaaccccctttctaaacttctattagagcctcatgtggattgtcactgttttggtggatgataaaactttgtatatgcactcaattactgcttgtttagtgaatgcattaagagatgctgatatcattcaacgaatttaataaaccaatttgagtggcatataacatgatcaatatttttctcaggtaaaaaaatgggatatttttagagaggttctccatagtggcatggtatattgctctggaatatcttcaaaaagcactaattcatgtacttaattttgtcttttacttgcgacagaggaaaaaaaatagagttgcatggaaccagattatctttctactgctattggcagtcagtatattttgaatgataacactaagtctcagttaaagcactaaattctcttctttaaagtgaaaaaaatatgatgcaatttgatcaaaatacatagggacaagtttacaacatatatctatttgtttatttcatatctaaaagttatttctttactgaaaattgtacatatgaggcttcagactccaacgtgcttctgcgtgtgtttgtttaatatatgggctgcttggttgatttttttcacagtaaccattactggctcatgccaaacaattgcctgctaacagccactgtctacatcctgtcttctaaaataatttcatagtaaatattgaaactcattctcttattcattattagtcaatcaacaaaggccaagatagcagaaattaccaaagctttgatttgccttatcgatgaaggtatcttacggggttgattttacccattttacgataattactcagaatggaaagataacctaaggtacattatgtgcgtgtatatgtattcatgtgtgtgtgcacgctcatgtgtgtgcacatgttcatatgcatgattttggacataaaataaccaggaaagaaataccttaactgtttggggggtttgtgatatcattcacagctcttttctgaaagaatttttccttggacatctagaatgatttttcttatctcatctatagattgagaaaaaatagactaaataaaatggtctttttaaaattatccagttggccaggcatggtggctcacgtctgcaatcccagcactttgggaggctgagacaggcagaccacctgaggtcggagatctagaccagcctgaccaacatggtgaaatctcgtctctactaaaaatacaaaaattagccaggtgtgggggtgggcacctgtaatcccagctactcgggaggctaaggcaggagaattgcttgaagcctggaggcagaggttgcagtgagctgagatcatgccactccagcctgggtgacaaaagcaaaattccatctcaaaaaaaaaaaagtatccaattgaggggaaaagttttgataaaatgttcatcagtttcaactaaaccacactgtcaagaaatgaggaccattagacattctctgaaaattttaaattatgatatattcacaaaattgtgtaatgttaatgtattaaaagatcaaattacatcaaaatagtttgttttggacttgttttcaagttggagtaaaggaggctgaacttaatctcctgcctgaaacacctgaaacacttaaaaaaaaaaaaaaaaaaaaaaagacaaaatatatgctacaacggttttcaacacattgaacatcagacattgaaggacagtgatccttgccaggaggcttttgttaaaagatgaagctgagagtttcagcagcccaaggctgactagtgatcacagggcaaaataccagagaggtgatatatacacagaggaaattttggagatttgtagaaagctttattttattcttcatctgagtcttgatcagttcatgtatgcaagaaaaccactcaaagctaaggaaagaacttcacaaaagaattaaaggaaacaatcaccagagctcacacgtggctagtaataccacctgttcccacgagccccagtgaaaaattttatcattcacaggacatcagagagagtactcagaagggttttgcctcagtagtggggaaaaagtagccctaaacttacactgttctggtcataacaaagcataaaaggaagattctcaaaagatcaaattgtttccaagtgaattaactgtgttccagaacgaggtttgagaatatttatttcaatatatttgaatttatttgaagtatcaagcacgcgctaagttaaaattcacaatgtctggcatatagtcaaaaattaccagtcatccaaagaagcagttaaacaacacacttaatgaggagaaaaataaatcaatttaaattaacccagaatagacacagatgataaaattagtagagaagaatattctaacagttattatatctgtattccatatagtcaagaaagtaaagactgaacatgttgagtagacacatggaagaaataaaaagacccaacttttacttctaagagatgaaaatgtctgatgttaaaaatatatactacatgggattagccatagattagactttgaaaaagattagtcaatttgacaatagagattatataaaacaaattacagagaaaagagagaccaaacagacaatgaacataacatcagtgagtagtggggcactttaaggagcctaataaatgtacaattggagttccattttttttaaaaaaatggttgaaaggtttctaaatttgatgaaatgttaaatgcacagattcaagagcttaactgacttcaagaacaagaaacatgaagaaaactacaccaagttacatcaaaacaaattgcttcatcgtaaaagtactccctagttaaccttctacatacaaatctccattttacaatggctttccaagaaacccagcctgaaatatgtagcaaaattcatactgaacaactatcctccaaagagtagaatggaggtacttttacaaatttctatgttacttgatttttttcacaataagtactaatttgataataaaatataaattgaaatatataactaccttgggttggatatcattgaaaatggcaagtggtttctatatctaccccaaaacattttatataactctaatatgtttctgcctctcaggcagaaaccccattatgctacattagcccaaaattcacttcagtgctatttttaaaatgtatcttctatattaaagcagattgggaatccatacatttcctctctatacaaatgccaacgctggtgtgcatgcaagtttgattgatacacatataattacacaaggttttaaaaatattttctgtgtttaaatagcttatcatataaataggtgtttaaatgcttaactccttaatattaaagggcatatttactatggaaacatatttgagaatgaagacttgtaaagtcaaatgtgatactgcttttgtgaatccagcattttgaaatatctaaagtatttaataaactactgggtgttttttgccctcatctgtcttaatcagtattttctggcattaaaaattggctacaattcaaatccacttgattgactattgcaacatgaacaatttgagctaaaaaagatgcaaaaataattaagtcttcgtgtaataaacacagtgtttcttatgcctaaactatgtaatttagcaaccaaattatatcctggacaatctaatctatctttacctgcatattcaaaggacaccacaagttgaaattaaactacacactggttatcatccatatgctgtttccctattaacataaaccataaaatgtcaataagtaccaacaattaactctgcattgttttggcctctggactatttcagaaggcattttgtcaatagaatatatagaaatattgctacagcactacaaaattgtctttaggaaaacagaactgtaattttatcatgatggatatttctagcaacttcattttagctaagtatgccacaagttctccttctggaaaggttccaacataaagccgaaatacacactgccccaaagccacaaaacaccttgctgttacgatgcttccctctgtcacagattcaattatattttgcagtttatcagataaaccagctccgtccaggcaaactctctcatcctgacacaaaaagtccatagcaccgtgctctaatattatcattatgataattttctttctagtaatataatgatgacaacaacagtcaaaagtaatttccatcacccttcagaacctgatctttaagaagttaaagagtccagatgtgctgaagataaatacaatttcgaaaaaacaaatcaaagacttaccttaagataccatttgtatttagcatgttcccaattctcaggaatttgtgtctttctgagaaactgttcagcttctgttagccactgattaaatatctttatatcataatgaaaacgccgccatttctcaacagatctgtcaaatcgcctgcaggtaaaagcatatggatcaagaaaaatagatggattatgtaaaacagattatagagatatagcgtatattttttggttatactgacaaagatatcactctgatagtttcctgcatttgcagagtttagtttcaagtaacaaataaaaattaatatacacacctagcatgtacacacaacattttaaaaaaatactcaatataaaagctgattttaaatggaaggttgcaatttttccctttaaaatgaatatatttattgattaaaagaaagataaagcaactattttggactattggcattttctttcctaaaaatatatttttttaattctagaaatttacaaatatcttaacattgtaataaattatttggaagcaatatattccctttcaaaatatttttggataaaaattacttcataaattctatcactttcaatattattcttgatccaaaactgcctgttcatcaactgaaaggagtaataagttctagtgttctattgcatagtaatatgaacaaagttaccaatattgtgctgtatatttcaaaatagtgaaagagaattttaaattttctcaccacagagaaattataaatgtttgaggctatggatctgccaagaaacctgatttgatcattacacaatgaaacattacactgaaacgtcacactgtaccccataaatacatatagttattacaaataaaactttaaaaatataactaaaataccattatcacaccaataaatcaataattcgtcactatcattaaagattctgtcaatatttaaaataagatgacagatataattcatattgtaggctcacatgtaagcattaaataaccgatatactaaactatgcgatgccttctttaatccttcttattttattgtagtcactaaaattttagattggaatactgcaggaacttagtacaagtcaaatgtgttaatactacacatggaaagaatattaggaaacaagcatttggtcaccttccagtcataaaagagactgaggcagaaataatatgaaccagggctgtatgtttacctaagacagttgcacataagaatcaactggggcatttaaaacacagcaacaacaataaccaaacagtgatcctggggctccattccagaccaacttaatcagtatttctggaggttggacactgacgctgttatttttcaaagcatccaggtgatttcaatgtacagtcaaggtgaaaaacactgccgtaaagtaagatttgaaatcttactgggcttacagtctaccagatttcctggggcctgcccaagcaagcatttgtgagcacaaaaccaatagccatcctacagattaccggctatggtgctgcctcagagtacaggaatctgtcaagcttttctgaactctattcttaagaagcaatggatcatacttttgaataccatgatatcttttcagtcctctaccttcattcaggaatttaaagtaacactagaagttttaaattgctacatctgcctactgatgtcctgggcagagaaaggaattaacatttattaaacagttactaatagccaggcaccgggctctgtgcttttatagtgccagacacatcatttcattgacacctacaataaccctgcagcataacaattattattcccattttccattggagaaaacagaggccaagtaatttgccaaaaggtgaaaatggtattaaatagtagagagaggcttctaacccaaatatctcttgtttcaatggcacttttctaccagtgcacatgctctcttgtgaaattatttttccaagatgaagcttcactttatcagttaaacaattaaaagtgatagttctagaggttttttccccttatttttattaactacccaaaatttaataatgtatctacatgtacattgcactcattgtatttaatgaataattatatgcttaacctttaaaatcttgtaaaacagacagcattttggtagcataaaaaaggcaaccgaaggtagccgaagaggtattctctaactgtagttagtgaaaaataagaatgttgcctttgatgatttatggtattctagagttattcagatacaatatatccttccacaacaaaatgatcttgccaatgtttttgcatgtttactaataatttagcattcatatattttcaatggtatataacacacaataaatgacctatgaatatatcgtaagtttattccctttaaaaatgaattgcacattgcatatgttacatgcatttgcatcactggagtcaaagagttgcttttgaatgagaatctaaaaatctatgcaacatagttagcattgttccatactggtgagactatattttcttatataatttttctatatttttcaatttgtctacaatgtgcttttcatattgagagtcagaaaaatgaaataatttaaaatttttttttaaatggcagtctcatatgcaaatgactgctaactccaaccctcctcctgctaccacagtctgagaaacagtcagcagctaaccagagcacagagaagtaccagttggtcacgacttaccactccacctttgtagcaaccatcagtctccactcttggtttgctgtttttcctacccaatcacttgaactatacttttgccaacacttttagctactaggaggtgactgtttctctgacatactgctataaatgcccattcttcatttcaggatcctgtacacctcaaagattttcgatttcaaacctgttgcacagacttgtttctcaatcactcatcatattggtaattgccatcctctatcaaattcaacaaatccccctctcaccctgaattcttttcctttttacaagttatctacaagtttctacaagttatctttcctttacattctcccaagagaagaaaaccgtaagggttcatacacttgctcatggtatccgtagctctgtaagacagagctggaggtaggaagagaaggggaacaggccttccacttacaccattgttccaggcccacaagagggaggcaggatggactttctgcccgacccctgctactgtcttaggacttgtgaatttgcatatcggtagcatatttctgaaatgcccttcttccctttttctctcgtctcctcgtataatccaaacttttgcatcctcaaggacctaataaaaatgacttatgctgtcactttataaatatataaatatgaagtatttattacagcatgcaactgctaaacctttgaaaactgtaaagttgatttaattttattattgaaattactgttgaaataagtaactattcaaacaaaatattaaagaataaaatcatgggctttacatgtgatgacacttaatgtgagtaataatactttagactccatttcaagcctcacataaaattttaaaatacacttttcagtatttaataggtgctgttaatagcacagtctaaatctattcttgaatttactacgtaaaattacattttttatcatgactacttttaaactcttttccaccaaggaaaattccaaatgaaaaaaatatatatatattttttctggttttacaaagttagatttaccaatttaatatctaattagtcactgtgctccctaaatttgtctcgctccattaattgggctgcccatgaatgaagcaaatggtaacaatgagaaacaagtagagacatcaaaaatagcattcagggaaacaaatataatttttgccttctgtaatatttctaggaaaaaaagttttttttcttggcagtaagaagaaatatggatggaacttaacaaagggcaaaaaaatgtcagtataaacataaggataataaatcaagtgattttagaattttgcaaatattaaaattctcattcaccgtgcaaccggtatttaaaattacactgctgcttcatttatgtgcagcataacttattttctgatgttctaaatcaagttagtcagattattctcaagcataaattacatttagggagtaattcggtactctggggcatactttaacactttcgggccattaaggtggtagtaaattccatgaaatagatttaaataaataacaccctagtagacttctgacatatccattgttgctttatacttcggtctggaaactcagcattggactgctgattatttcatcccatcccacatatttcatctttgattaggtgaggaggagggacctgagctcgtgtctcatggtccaaactgtatgtgcgaataaataagttagttatctgccccaaatcatagtaccttgctacttctccccaaccctcaacttcccaagtaatacaaatatttagtaaaagataagtatactaccaattatgaagtacttacctcctaaggttaattgtgggagctcaataaatgagtatatataaatttctttttttacatcttttattttattaatgtttttaaaaaattcaaattcaatagtctttggaatacaagtgatttttggttacatgaatgaattgtatagaagtaaaatcagatattttagtgcacgtgtcacccaagtagtgtacattacaccccaaaggtaattttttatccctcactaccttcccactctgccccttctgagtcttcaaagtccattctaccactctgtctgcctttgtgtacctacagcgtagctcccacttataagtgagaacatacagtatttggttttccattcctgaattacttcacttagaataatggcatccagctccatcaaagttgctgcaaaagacattatttcattattttctacggctgagtagtattgcatggtatgtggctgaatagtatttcacggtatatgaaaatatatgccacattttctttatccactcattggtcggctggcacttaggatggttccatatctttgcaactgtgaattgtgctgctataaacatatgcgtgcaagtgtctttttgatataatgaattctcttcctctaggtacataatcggtagtgagatttccagatcaaatgttagatctacttttagttctttaagaaatcttcatactgttttccatgtaggttgtactaatttacaatcaccagcagtgtacaaatgttccgttttcatcacattcacaacaaaatctattcaaaacctctgggatacagcaaaagcaaggctaagaggaaattttctagcaccaaatgcctacatcaaagagcctgaaagttcacagtctgactacctaacatcacacctgaaggaactagagaatcaacaacaaagccaacacaaagctccagaagaaaagaaataacaaagatcagagcagaactaaatgaaattgaaacaaaaatataaaagatcaatgaaacaaaatgttgattctttgaaaagataagtaaaattgatagaccagtagttagattaaccaagaaaaaaagagagaagattcaagtaagctcagttacaaatgaaaatgcaaatttcttaaaacagcatctggcagtgttccacaagtatgagtagtagtagttgttgtcattattagtgtacctctatttggcttaagactttaaatgcaaataaaatgaccaacatagaatctgagccatgctagtgtctctctggtggggaatagacccacccataaattagaaattccttcttgagaaattaccttctttaatttcaggacttaaagtatttaaataggcagtgtcattagcctgctgatgaaatctgaatcattatttcagcatagaatccatggttggccatgcctatccctgagtacattacatatatttactttttaaatgctttttgttgtgaaacataatatagggaaccattcatataaacccatggtgaccatcacccagaccaagaaataaaacttccagcagccaaatggaacactctatatcatagtttcaagattaatctacctctttgcttattagttgttgattaatttctcactgtatgattgtcttagtctgtttgtgctgttataacaaaatgcctgagactgggtaatttacaaataataccaatgtattcactcacagttctggaggctgggaagtccaagataaaggctctggcatttggtgtctggtgagggccttcctgctgtatcttcacaaggcagaaggtagaagggcaagagagcaagctgactgaatgctgcgtgaagccttgtttataagggtcttatttttattaacaaagaaggagccctcatggcctaatcaccacttaaacaccctacctcttagtactagcacattatcgacacctgaatttggaaagagacacattcaaactatagcaaattttactattaataaatactgaagtagttttggtttggggctattactatgctgctatgacattcccaaacatgtctcctggaatatgaacatatgcatttctgtagagtgtatatatagaagtgaaattggtgggctataggttatgcagatctttgaatttactaaatagtgccaaatggatttcactccaagaagcagtagtgtaattttacacttctatttacaattcacagaccaagtaacattgtgtgaaatttctaattgctgtatattctcaccaccacatggaattgtcagacttataaatttcaatgattctggttggtaagcagtgatatttcattttagttttaatttgcatggcctggaccattaatgggacttagaaattctttatatatttattggccgtttggatttcttattttgtaaagatgacaaaaatcttaacgttactatgatgcataaaacacattagttatttactataaagtgatcaccttaaaaatgccatccaggtcaagatacagaatattgccagcaggccacaagccctttttgtgccatggttcacttttcaagaacttttcccatttttctattggattatctgttcttttctgaaagatttgtaggaattctttataattatgaatacacacatttcatccattatgtgtgtattccaaataatttatcctactctgtgggtttcatttttactctctcagtgctgtcttttgatgtatagatgttattaatatacaaggtagtccactttattatttttattcatgattagtgcttcatcatttgtgtaagcaattttttcttaccctatattaattaacatattctcctctattttactgtaaaagctttatcaatttgtttttttctcatgtcagtttttagtcacctgggattttatttttgtatatagtttgaaacagaatatatacttttttcctaagcaggagactccattttaattttttaggtaaaacatgtgcactgtacaagataatgcatgaacagcagaaaaataaaagtgtgtgcagtgaaaagcatctgtcccaattttgatctgctcactctggtagttctgctctcactgttaataaaaattttataattttaaatatttatagaacaaggcaaagaaataaacacagtgatataaaatgatagtctcctcattcagttttactgctttcaatatattcaatgctgatatttttacaactctggattgacattatactttgtaacactctattttattgatccctaatcctccctaggttgtgagccttgttctcaggcttcaaatacgtttggagtcatactttgattttaagtttctcacagtgtttataatacttgagcttaggaactcattctcatgcctttatcccctctcttcgctgttgaaattctacacattttttcccttatttctcataacttcacttattgcattctgaataaacagcaaagataaattttctttgacctgtaccaccaacatcaacacctaaagtgacctctttcccattataggggactcttctactgtgcttaatggagactaggatgtgttcccctcaaaggaattctagtttttataggtaaacttgttaaatgtcttgtatggacactgccttatgaaacctcatttgctttcaaagcttcaactaacatctacagcaggtattggcaaactttatagataaagatcttgagaacaaatatttcaggctttgtgggccgtatggtttttgttacaactactcaactctgccttgaagttcaaaaaaaaggtatacatggagcataagcaaatggatatggctgggattcaatactactttacaaaaacaagtggtgggtgtaattggcccatgggcaggagattattgactcttaatctaggctgattatgacatagctccaaatttcagcccttatctgaggtatatagccaactgctacttggactatcctcatcagaacatttgatgtgaacctcaaagatgttatgtcaacaattccttattttcccatgcaagtctttgatatgatttggatctgtgtccccacccaaatctcatattaaattgtaatccccaatgttggaggtggggcctggtgagaggtgactggatcatcagggtggtttctcacggtttaataccatcctcttggtactgtcctcatgaaaatgagtgagttctccaagatctggttgtttaaaagtaggtagccacccacccccaccaccaactctctctctctgctttcgccatgtgaaatgcctacacctgctctgccttccaccatgagtaaaagctccctgaggcctccccagaaacagatgttgctatgcttcctgtagagcctgcagaatcgtcagccaattaaacctctttactttataaacacccagtctcaggtatttctttatagcaatgcaagaatggcctaatccagtccttagttttaattttagtcaatgatttccaagctagaaatcttgagaccatcgtttacttctcgacttctttcttatcatgcttgtctctatattttatcaattctaaaccagaaatgactctttaatttagcctcttctctctagccccactgtcgtggcctttcttgaaaactcctaataacttttcctcagcatattccaactcatctctccctattttcggtttctcagcgctctctaacagacaacctcacttcctactttggtccctatacaaacattcacatagcccaccatgtatactgtactgaaaacatagaaaatctgaaaattttcataacaaccaaaattccttttttactgtgggccttttgctgtattttagaatgacaccctatctaaaatgtcactattccataaggcttctctcccttggaattagttacttcataagacaagcttccacagctttgtgaaaacctctattaacatactacttcatgttctaattatgtatttacaaggctgtttgttccagtacactatgtacctcttagaataaggaagatgttttatgcacctttgaattcctggtactaagcgctgttcctggtacatgataaatgttgaatacattttaataactgaatgaatgaataaaaaagtccatgagtaatttcacaaaccccttatatcttccatttaagagccatgaatgcttggatacactattttacctctgagtctcagttatctcacacataaacccagaataatactgcctacctcattcagctttttcaggaggatgaaagtacactccaagttataaatagcaataaaatttagtattatcgatattaatacagttagtaatctataaatttttaataccgacacagaatttagaataaaaaaatcaatctacatcagaaatcattttccaaatatatcagcaatcacataattgttgttttcattaataaaagacacaaaatgatgattcttaaagataaataatttagcaagttcaacaccatcctaaaaagaatacactttgcacaaatttactgagacctaatttaaatatgaggatgcacatttagggactgtgactcttttaaggtgagtgttttaaaccaaaacaatattgataaaattcaccctaaagaagtcaatagcattatttaaaaacagatgattggataaagaatatgtggagatatatctccacatattcttttatttatatgtgtgtgaatgaatgtattccattgtgtagtattccattgtgtgtctatcctagcttctaagtctaagcatatatatatatatatatatatatatatatatatatatatatatatatgtacacacacacaaattgcgtatggaataaacaatttcatatacacaatgaaaaatactacaaagccatagtaaagaatgaaatcatgtcttttgcagcaacatggatggaactggtggtcatcttaagtggaataactcaaaaacagaaagtcaaatattgcatgttctcacttacaagtggaagctaaataatgtgtacacatgcgcacagagtgtggaataatagacactggagactcagaagggcgagagggtgggatgggggcgaaggataggaaattgcttaatggagaaaaggtacatcatttgcatgatgggtacacaaaaaaccagacttcgccactctgcaatatatccatgtaacaaaaatgtacttgtataccttaaatttatacaaacaaaaaaataataaaattacttaaatgttgattgcattatttgtaagaactcacaaacaattcaggttatcactaagactattaaaataaatcttaaaattctttagatttctaaagtgttgtttaaactttgctggactcttattgggcttaaatctctagacaggcagatctgtggaggaggacgctgtaacagaaaagcctcatcaataagctgaaattgctttagataaacgaggactttttgatctgaaagtgcacacaaaaatacatatactttaatatgtatataagtatacacacatatcagaaacttggcctgagtgatttttagggggctaaggggaccttaattaagcactctattttggcttaggggaaaacaccgtaaatatccttgagataaattgataagtactcaaatagttagagattcatttctttacctatgcttggtatctgattatttaactccttagtaataacaaagaaagcaaaagtgtccctgatattactattgtctagaactccgcaaattttctttgcccttctcttttataaatctctttgacacaatataatgttccagcagacaactgacaatgtaaaggttgtgatatttgaaaattccatcatgatggaaaaatattcagggtgtactattcctgcactgcttctgaaaaaatatgtaggattatgctaatattaacctaaaattatgcaatttcaatgtcttgatttggcacaattagcaccctgtaaaaatacccaaagtagcagaaatagtttgctattagtgatctgtaatgctacttttaataccaagaccttttggagaaatcagctacagaaactgactcagcaggctaagttaaataatttaaatttcttaataagtttaaactgacatactctctgaggatttgatatattcaagggtctcctttataaaatgtgagcatttaattgagtcttaatttacatatcctctactatatagtccacatgaagaggatatggtgttagacatcctagcttccaagtcttagctttcatttgttggctagaggggatatttgaaataatgatgcctttctcttcattcaaacacaaaacatatataataggtgtaggaacttttacccagaaataggagcaaaagcaaccacaaatatatgctatgcactctaattaaaacttcagattaagtacatgattaaatatactccacagcaccttggggtaggtactatcattttattcattttgcaaatgagaaaactgagactttgggagtctaacttgtatgtttctaatcaggaatgcaagacaataacatagctgaataaggatagcttatagtgtatgttttttgtttcttgttttttttaagtgtcatttgaatcagtaaacactgtattagcttgtgaaagagaaaaaatcctacttctcctataatatactatcctcttggaaataaatcatgttgttattggatagttacactcacgtgtttctgatcatgaaatttatatttcaaaggaatggattaataaataacctaacctcctttctaagcagcatttgctcaaaataacatatttctagacacttctcattatatatcatgacaagtacctcatactctcaaatcaaaatggaatttctcttgatttttcagaaacatccttggtggttcttcatcttttggtttatttttgtttatattattccttttcttaaagtatcgttgcttatattgtcctaaatttttctataccttcctccatgagaacctttctgatactaccaattagaagtaatccctcccctctttaataacactctttttattagggtgattatttttcttgattcttttttgtaaccaccttaatgaagtatgattgacatacaaaaagctgtacatattttacatatatatatatatatctcaaagagtttcatcatatatatatatatatatatatatatatatatatatatatatataaaatcaaagagtttgggaataagtatacacccacaaaaccatcgccaccatgaaggctataaacatatctgtcatcactcaaaatttcctcttgtcccctttattattgttgttactggtggtaagaacacaacataagatttcttaggaaattttaagtgtccgaaacagcattattagctataggcactatgctgtataatagatctccagaattttatcttccataactgaaactttgtagtctttaacactccttttgtcctgctttaaagaatttattctactctaatttacattagtgtcattacgtctaaaccacactaaatgctccctaagggtagaaactatattgaatcaccatttttacctcctataacaggtgccaaaaaataatgttgcacttaatttttgcagattcaaatttatccataagtaattttaatacaaataattggtatccacttcaaatgagtataccttctgaaaagaaacatggttttttttgttttgttttgttttgttttgttatttttgagacggagtctcgctctgtcaaccaggctggagtgcagcggcgcgatctcggctcactacaagctctgcctcccaggttcacgcctttctcccgcctcagcttcccgagtagctgggactacaggcgcccgccaccacgcccggctaattttttgtattttttagtagagacggggtttcaccttgttggccaggacggtctcgatctcctgacctcgtgatccttctgcctcggcctcccaaagtgctgggattacaggcgtgagccaccgcgcccggccaaaaacatgttctttagaactcccaaagtatcatcttttagtatgaagattttttttgaaattaagaacaagtagtaaaacaatcaggttgtacagcatacaaaatttgaagacaagcaaacgtgagtttgaaattctgttttattgcctaacagtgctttgtaaacttcagcaagtgatttaatttcctgatttcagagttctcatttgtgaaataggcataatatatatttcacagggttgttataagaattaaaaataatacagtgaagttttctgagcccatagtaagtgctcaatggtggcaataacaataatcataatatccaaatatatatacagtatataatttctgttatttagaaaatattaagttatcaaatacatgtacacatatatgaatattttcaatatctatgaatgaggaaaatatgtataactgattttatacatttcctcattggcacatgaaagttgtatatcttcagctaaatttagtcttcttgccctttaaggctcaaacattttactatgtgtaaatgattttactgctattgtaattgggcaaaccaaaacaattacagtaaatggaatcatatgtctttgtttcgttctcaacgagggaggaacagtacacttaacacagctacaaaaaaatttaacttacttttttctgctaaaggaaaatgagatgaaaaagccattttattttaaaacgaatggcagattttgatttcgaggcaagtaaggcaatttcgtgttatcttcccaaaagtatggtgagaatacgaattccaaatatgcggagtatgaataaaaaatagaaaggtatgacatttttcttcttaggcagccaaaatgatatttcttccataggctgctgcggcaaatcaaaatacaccacttgagatcagcttacgaaaatgtcccttttacatgggactcattttctttggccataaaaaattaaagattaagatctctgtctatctttgaatatatatggcatgagaccacacttacaaatacataaataaaactgaaacaattcactttttacttagctttattctaaacgggaaattctattttctctcttactactattctactttctctattttctctcactggcaccattaccttccacaagactgtttttcctgtgaaggtagttataattaacaagagcctatacacacataaaagttttcatttaccatattagtgaacatatcaagctatcatttttcttaatgtttactaagttttactttattgaaaccaatctcaaaggttgcagcatttaaaaaagtgacatttataattctcaattataaaataattttccaaagaaagaaaaaaattccaattttacttttataagttggaatttactatatatacacacaaatatagtatgatttgtgtgtgtttgcaacacacaaatatagtattattgaaaaaggaggaatttagatgttccaagtggcattaacagaaaattagttctgaaattatgccagattagcatttcaactagaaattatgccagattagcatttcaactagaaatagcaaggaaaaacttctaggctataagaggtcataagtagtaaagaaaataagaactattttcaggagacatgacctattctgccgggagttgcacccataaggcagagggaacgggtccaaaatattttcttataaaaatagagatacagtaattaatttcaaggcagatttcagtttatctatttttgataaatttgttaaatcaattaaatatgccaggggccccttattaggagtatggctgtaaggctaattttagtttgaatctactgacaccataaacattaagaggatttcacccccactcctacccactccctagcctgtatgtaactgtgggagcagggcagttccaggatgacaccatgttagaaagacaacttcactgcaaatttactgaactgaaatctgacccaagtatagcagctctaagtcaaagaaaatgtcatcacatctgacttactaccttatgagtaaatatcatcacaaaagtcgggccccttttgctattttatattctatcttattaaaacacaggtgcacgagggaaatgttcttggcataaaactactacattcattaaattttttctttcccacaccggaaggcacatgtctaaacctgtaggggttgctttattatttaattagagcagattcttttctatcattttaggtgtttcatctaaagtttgattaacatcagtatatgctgtgctctcaggcaagtaaatatagctgccgtagaaagagaaataagcagaagcaacattttaaaaaataaagaataacatgaacatggaaagaaaaagaacctttaagaaataaaatatccacaaagctcactagaaatgcttcctaaacgtgtatgaagcgtatgtgtttgtacattttatttcaccactgattcatttactcaatcttttgataaacatttattgagcgcttagtcctgaggctagcagtgtgttgaattcggaaggtgtaaagctgaaaaagatactatctctatcaatgggcaattgacagtttagttgcacagtattttaaggagggtatgaactgaagttgtagcacatgctgtacttgctccatgcacttccccttgcctttccatttcaaaatacactggtttgacttccaaatgccagcatttggatttcattacctatggaatctttctggttgcagaggtctgatgctgatgttactggggtggggagcatatttttcaaccagtggcatggaaggaatggcccaagggctagttgggcaagatgtactagatcaacattatgaaggttcatgaatatcaaagtttttgagttcatttatgcagaagtagtttattgcaaaagagtaccacacaaaataaatagctgcagatctttcacaatacaataaattaaaaaaacttcttggagggggagaatatatagagcattcccaatccacttcctggtacaatttctttttcttttatttatttatttatttatttatttatttatttatttatttatttattgagacggagcttcgctcttgttgccccagctggagtgcaatggtgtgatcttctctcaccacaacctatgcctccagggtggaagagattctcttgccttagcctcctgagtagctggggttacaggcatgcgccaccatgcctggctaattttgtattttaagtagagagggtttctccatgttgctcagtctggtctcgaactcccgacctcaggtgatccgcccaccttggtctctcaaagtgctgggattacaggcatgagtcaccacacccagcccggtacaatttcttaggcttcattttgtgccaaaattgtatatatatgtaagctatacttcaccatgttttccattaaccctacaactgcgatttcggcagcttcatgcttctcaagagccatggtatgggtcacagtaaaactggctggtccaccaaatagacagcagggacggcagtggtgaatagtcccatgaccacgagagaccagaaagaattagttgtctatagctactcttgtctgtgagattatagttcattttcgccttgaaaggaaggttttagttatgttgggtcaggaaaagacagatgggttattatttattgcctatcagttttaaccacgtgcaaatgaacgttatgcaagatgagagcataggagaagctagaagtctaatcagttcttgaagaaggaaagtgaaattgtgacatttgacatttaaaaatataattttgtaagctataaagaagggggtggtgagaagttagaatagtggtttgcaaacttgctgtacaatggagtcatccaaggatcttaaaaaaaaaatacaccagagatctgattcaactgatttgggacatggccagggcatcagaattttcacccaatattttaacataacaaatttcaaaaatgcaataacatttttaaaaattacaagtgatatctatatatctagattccaccatgaacattttactatactcgttttgatcacatatcttttccttcctccgatccatccatcaatcaatcatatttttgatgcatatccaggtaaactgctgacatcagtatcattcaccttaaatacctcaatatggatatcactgaatagaattcataaggtttctttattattatgttattatttactgtatttggtgtcctctttaccttatggccaattcaagtaataactctgcaaggtagttattacttagaaggaaaaaaagattcagagacattaagtcatcttttaatgttcacatgggaagtaaaaggtagagttggattcaaatccagctttcacttatcccataaaacagtggtccctgacccttttggcaccaggaactgattttgtggaagacaatttttccgtggaccgggttggaggatggtttccatatgattcaagtgcattacagttattgcacacattatttatattattatcacattataatatataatgaaataattatacaactcaccataatgtagattcagtgggagccttgagcttcctttcctgcagctagatggtcccatctggggggtgatgggagacagtgacagatcatgcagcattagattctcataaggagcatgcaacctagatcccttgcatgagtagttcacaatagggtttgtgctcctatgggaatttaatgtggctgctgatctgacaggaggtggagctcaggcagaaatggagtgatgaggagcagctgtaaatacagatgaagcttccttccctagcccgctgctgctcacctactgctttgcgaatcgggtccctaacaggcaacggattggtacgggtctgtggctctggggttgaggtaccctgccataaaatactatatttttttcatttttccaaatgtctctaatgctatgagggtagaagtggaaaggagtcgaattagatatttaatttgaagtctacccattacaattttggaaggttagaggccaaaagggggtgtatcttgttttattttttcaactttttctaacatgacaactgttgaaaaataagtatcatgtacaaaaggtaaataaaagtggccttcactttgttttcatttggagtatttattcatcttataatgccttaacatggatttttaacttaatgaaatcgcccttaaatttgtcattaacagactattgttttagttttagtgttttttaactatgaaaatattgtcattgtattaaaaaataagaatttccaagttacaaaatgacagtgaaaaaaaccagccataccattccaccctcacataacagctatcaggatgaagaataatttttctctttatcatttattagttctctaacctaattttttaaggaattcatttaaaatcatggtaaaataaaatgaaaatataactaataagatagtatttgaggtgataggatttcctcctcagcaatgaaaatcttacataatcatttaaagaccggtgaagtgctgaaaatcagacaaaattacaatgtgaaaatcatcaagaggaaacaagtctattttaaaggaatgccaattagactgacaacttaccgttcaacagaaaatatggaagcctgagaacaatcatgctatcttcaatgtgattaactggaatgctgtttggtaggacatgccatcctcagtttaactagattattgctaaattacactctaaattggttgtaccaacttaaatttctacaagaatgagagtttgtgacctttcacaatcttattttattttttacttgttccagtccgatgggagtacgttatctcacttagtacgatatggtttggcagtgtccccacccaaatctcatcttgaattcctacatgttgtgggaaggacctcgtgggaggtaattgaatcatgggggcaggtccttcccatgctgttctcgtgatagtaaattagtctcatgagatctgatggttttataaaggggactttctttgccttctgccattcatgtaagatgtgacttgctcctccttgccttctgccaagattgtgaggcctccccagctgtgtggaactgtaagtccattaaatcctttttcctgtataaatgacccagtctcatgtatgtctttatcagcagcatgaaaaccgactaatatgaagtaatttttccaataataaatgagagttagcatctattcataagtgtatttgacatacagatgttctgtgaactgtctattattttttaaactttaaaaatattttcctgttaggttatttttattttgttctattgataggtaaatatttttcttaaattatgacataaatcctttattgttttagtattgcaaatatactatctgagcctatgtcttttctttgtttatgaagtctttgcattgtacaggtttttaattaaaatgatcaaatatatgtctttttctttacaatttttgctttgtgctgttgcttaagggacacctcttttgccctacatgccccaaaatatttttatatattttaatgctttgcctttcatgtttaggcaatccatcaatttaccatttttatgtttatgtacagtgtgagatagggatctaattcttatgtttaataaaattttaaatggtacttctgtctgtcatacatgtcatatattatactcttacacaataagaataccacctctcaatacattcgaatacattagattttttttttcttggtaacaaaattcctggagcactattttcttctccaatctgtacaggtttctctctacaactgttatacagctgttgttacaggatctcctccaccatctttctggcaccactttgcatcttcctcccacgttgggttctctgttttccggatcctaggctttgcaggtaatactaatgctccaatattttcctaattctcttacctctcttaaaaatattagtgattataatcccctgtcccctcagagttaggcatgaccacgtgacttcctttggatgatgaagtgaaatgaaaatgacatatatcactcctacatagaggcatgtaagagtcagtttaaaattttccacgcatttttgactgacatggtgaacgctaaagcttcttattgttacggtagaatgatagaatactagagactgaatcagcttagattcctgagtgactacaatgatcagaacccttgactgacttgtgttggatatgttgcaaagatacaaaatcaacctttgtgtttctagccactaatattttggaattgcttattattgcagcataacaaggcgaatcatgcctaaaacactctccttctgatctccaatcacaactaaacattctttgtctttcttggtttctttcttcacttggtagagtatatttttgaaaatagatttctggggaaaaaaggtttaggggagtacataaggctatctctgaaaattattttctccgcacaatttatagtttatcagggtgtacaatttatatattgttgaataacaagtcattccaaaatttagcagcttaaaaacaaaaatgtttattatttggcagtttctgaaggtcaagaatctgagagtggcttagcagggtgggactggcatagcttattttatgaggttgtagttaagctgttgtctatgcttgcagcctctcgagatttgtctggtgttaaatgatgcacttctaagctcattcttgtggctctttgcaggaggccttagtttctcagcatacgtgcatctccatagggctgctcatgacatgtgttcccacagaagaagcaatgcatgagagagagagagagagagagagagagagaaagagagacacagagagagataggcgtggatggagaacacaagacataaaccacagtctttctacaacctacacttggaaatgacatatcatcacaaaagagtcactgaatctagtccacactcaatgacagggacatttagctgtaactcttgaatagaagagcatcacagaatttgtgaacataatttcatataggatatgaaatcaaagccaaagttaattattcctagaagtttaaaggaagtgttcctttctgctattttccatggctattgctgaaaagtccaaagccattctgatttctgatctgtgaacttctctttgtccttgtttttgtaaaaatttatgatgatgagccttggtgtagatttttagctcatttgctgtgctgggcatttagtaagccctttaaacctggacactcattttcttcagttctaagaaaactgatgttgtcacttctttgataattttctctccacagttgcctctcttctgttttatttttaacatctattatttgaatgttggattacatagaacaaggtttctaaacataaacactattgacactttgaaatgagtaattcttggttgtggatggctgcatggtgcattcctcttgcgtcactcttcacaagaggccagtagtacatcctttccttatttgtgacaacgaaaaaggtctccgtacattgtcaaacgtcctctgcaggacaaaatcacctctatttgtgaaacacttacctagaatgatcttctaagattcttatactctcccattttccatgcttttggctatttatactgctttatgagatatttcttcaaatttatcttctacttttgaacttttatttctgctcttcatttttaatagacttgattttttaaagcaattttacatttatagcaaaatcgaggggaaagtacagagatttcccgtatactctctggcccccttcctcattacacacagcctaccccgctatcaacatcccacaccagagtggtacatttgttataactgacttacatacattgatatatcattaacactcgaagtccatagtttacattagagtttgcttgtgatgttgtatcttctatgggtttggacaaatatataatgaaaggtatccaccattatagtatcacacagagtagtttcattgctctaaaactgctatgcataccatgtatgttattccagtggtggatatactaaaagctctgccttcaccactataaaatatattcatataacaaaattacactggtaacccataaatttatacaattaagaatttaaaaacttaacctgctatactattaatttaaataacccttatctttctcggaaataccaccttctatagtctcttgttctttcttatgaatacagtgactagtctcactgtgagataataattttatagctatctttaaaaagttttcttaaggtctatgccttgtctctctttctgcagagatttctgtttcatttatgtggctattgtttttttcccaatatttctgctttttgtttttatgttggtttctgtcttccatctttgagacatgttcaaatatctggaaatccttgattgtctcttaaaactgaggcattaaatgcttttggaaattccttgtgcgtatgtagggcttatacttggtgggcttcaatatatggtcattaggcacagatctggctatttcactggtggatcattacatatcattaattgtaggttactatgatctgagtgtgttcttgcaaaatttatacgttgaaatcctcaccctcaaggtgatgacattaggaagtggggcctttggaaggtaattaggtcataaggccaaagccatccagaatgagaatagtacccttacaaaagaggcccaagacagttcccttggacctgctgccttgtgaggttacagtgagaagacaggaaatgagctttcaccagacaccaaacctgccagtgccttgatcttgaacttcccagcctccagaacggtgagaaataaaggtctgttgtttataaggcatccagtctatggtattttgttatagcaataaaacttgactaaaaatagttttcgtattgcaggtaggctctcaggagaataaatttataatctactgcccagaggatagaaacttaagagccaagaaggtgaagagggactgctggtctcaccattaaatatgttgactttaacttaatcctgtattttcagtatggtggctctctcttccatcaactaatcctgttgtccaaatgccaaaagttgtttcagcctcaccagaaagcaaaccactcactcacgtctgctgggatgagagaggagtagtgtctaattaactaccctgagctggggacatgaaatgtaattgccccttttaagggattcaaaacaacccctttatttccagcccctctcgggaatatatggccttctaaaacacctagcgtcttcaatccacaagtttttctgggatcctgaaaaacaaattggcttacttgtcctaattttcatctcattgacttgatatgtctgtgcagatgtctcttcttccattttatttgtcattttatgactgtattgtttttattcccttagcgtaatctttgaacaatttgggagagagagaagataaatgtatgttttcgattgtcatttctattggaggtccatgttcacgtttgtgtcttgttctctctcctcaggtatcctcatctagcatttagtagttgcatgtgcatcgcgtcccgtggtctccagccacccctttaaggtttaaagttcttgcactgcaatgttactggggataatttcaatccattcatcaagcaagagaacagatgcaacacagttcccagcagcaaggctatgtctttattcttacacctacataggcccataagtttaggcaagccatagcgtcaggctacagcctgaagaagcactttttccccaggttttctttcacgaatgcaagcaccacagcccagcctctggttttgaatactgagtttgtctccagttccacaccttgcttgaagcaattttaatcccaactatcccgcagcatccaaattcctggcttccactgttgttttgtggttcagtgtcaagtctgtcagggacttccgccccattctctgctttacatttctgtaaatatatttctgtaaatacacatcatgatttgatatgtatttgattatcttgtcatcaacatatatttctgtaaatacagttctgtaaatatatccttttttattttctattttttcattgctgtattttgggagcagatgaggataacacttggattagaaatctctaatcattttgcattggtttttataataggtaccagcataacgtatatttttccataaggcatatacccaatagagggaccactattttatagccttaagtggaagctctgttatgagacatatgtgtctcaacccagccggttctatacagtttacaagaccaggtagatcatcatgctccccagagagacccaagataagatgattagggttatttttctagcacataaaatagacttccttttctgacatggaggcctgaatcctaaccaaatttccttggtaactgcaacaagaactgtctacatattgttccaattccaccttcagtccttcagggaacagtgtctggtgtgtggcctatgtaacattacacagcactctggagattccacagatctgcaggcctagtaacaaaaatagaagttcaactaaccaatcaaccaacaaggatcactctgggccacctaagtcctgttacagaagacaaagtaatgatcagtctcatcactcccctcctttaaacttcagtgtccttggtactaataacactcatgttggaaataaagccaatagaatcattctgcatatgctttattacctgaaataccacctttaacattaccctctgatgactttttaacagttaacttcaatgtctagcacgttgctatatgtctattttttttcaataatggaagcactagaagggaaatggcattattatgtacacgaaagatttatatacaaagagtatgtaacttattttatttgttaatacttttgctacttttccaaataagaaaaggtaaaacatgcaccctataaaatcacatggaacattttggttaaaaatgcttctgtgtgttctaaaacattataatacttcatttcttgagggttggattctcttatcatcaataataatatcatgtagttagaacgcattggcatagatatataatcattttatgggtccgtgaaatgaggatagaattgggaggtcacaatttttgtagcaatatttttgttattgttagtttttttgtggtactgaaaagaaagcaagcgaagaaagcaaggaaagcaaaggaacgcaaaggaaaaggaaaaggaaaaggaacagaaggaaaggaaaggaagaaggaaggaaggaaggaagaaacaaaagaaaggaaaggaaagcagaagtaaagaaaagaaagaaaaaaagaaaaaccaagcaagcaggcagacaggcagacaggcaggcaagcaagctagttaagtaagattttagataaggaaataaataggaataaataggagatgaaattatatgatcctagggctagggtaaagaaaagagcaaaaaggccataaaatctttctgtagcgtaataataaaaataacttcaaaagtgcttgggttgatgatagcctgacaaggattagcttgggtacataccaattaaagacagctggtctagaagctggtttcacatgatgctacagtaaactggtaaagcaagtattaaaacctaaggaacaaactctcctgtgatatttactggctcaacatcttaaggataaaagacaattatatgatgttaattaagacagtgctatgctggtaaatgtctaacaatcagatcccctgagaggaaggacatatttgaatattcccagtatgtttaattttaagctatcattataatgtcaccaaacatgaagttagcactacaccattatacagtcattccattatacaggtaacaaacccgtagataatagtgaaatataataaaagaattaggtagtgatgacttttgtgcatctagtacatttgtgaacaatatatttcatttaatgtaagttaccataatttaatttttgataatggttgtgtttaacagatctcaaaattcttgaaaatttaacaagtatttccagcacatcgactcaagttaaacattagtttatcacaatgtacacaaaagaagaggttcttatcagtacctatcccatacatcattaatttttcctattcttctcaggtattagtttatataaaattttgttttctctttgaaaataaggagtcttgcatttgtatgaaaattctaacaagaggaacgaacttttttttttttattatactttaagttttagggtacatgtgcacattgtgtaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccaccccacctatgagtgagaatatgcagtgtttggttttttgttcttgcgatagtttactgagaatgacggtttccagtttcatccatgtccctacaaaggacatgaactcatcattttttctggctgcatagtattccatggtgtatatgtgccacattttcttaatccagtctatcattgttggacatttgggttggttccaagtctttgttattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcattactctgatggccagtgatggtgaggattttttcatgtgttttttggctgcataaatgtcttcttttgagaagtgtctgttcatgtccttcgctcactttttgatggggttgtttgtttttttcttgtaaatttgtttgagttcattgtagattctggatattagccctttgtcagatgagtaggttgcgaaaattttctcccatgttgtaggttccctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagtcttcccagcaccatttattaaatagggaatcctttccccattgcttgttttcctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcagctagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttctgtacattgattttgtatcctgagactttgctgaagttgcttatcagcttaaggagattttgggctgagacgatggggttttctagataaacaatcatgtcgtctgcaaacagggacaatttgacttcctcttttcctaactgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtatgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgacggtagtttgtatttctgtgggatcggtggtgatatcacttctgttaactctacaagtcaaacctgaaatcatggctcacaaccagcaccacctaatgtcaggcattggaattgcatatgtagagcccagaattggttttccacgtacttcagagtcaaatgtgaagctaaatgcacacacacccacacaccctacagatatggccaggacccaccccagaccaaataaccaggatatctaatttatttttatagccatgtaggtaatttaaattcagttgttgaaccaagtttgaaaacgattgtcaaagaaagaggtattactgtaattctgattttaaaattttacatcatgaaaatcttcaaagacatatataagtaaagagaacagtatattatggacccccatgcacctgtcaccaccttgagcaattatcaacatttgcgaatcttgtttaatcttcctccattgctctttatattaaaaataatttccttggaagtttgtcaaaacaaaacccacgaatcacattacttcacctgaaaatactttggcatgtatctagaatttctctttaaatagcacaatctattatagtagcaataaatgccaaaaatcgttaagtatttcttttaaatattgagccagatatgatggtagttgctgcagatgtgaaaaaccttagtgacaattattttttaattttatcttacataaagccagttagattcagagacacatttggtcaaactttgtccttgacatataaatagtgtttctttcctaaactttccattatctggttaatttctcctaaactttccattatctggataatttctcctcattttttagaactcaattcaaggatcatctcacccggatccttccagactgagacccccaaactgtgttagacagtcctgctttggtatatgcctagctcccaaggcagacatgaactgaggactcgtcactgtgcattaaaactgtgagttcataattcctttctgtatatataaatacagaaatcagggtttatatgttattcagttttatatttctagccctcagaatcatagtagggtcacactaatctttgttgaatgaataatgagtctatgaatgaccagtttgacagagtttaagtgtggatgtcaaggataaatgaagaaattagccaagtctgctaatatgaagatgtatatttaaatgagaagattttataatcttacactttcataattatgaccacattgatttgaaggttttatgaagagaaagaggttatactaattatttgagctgtttcttttcataagtgattgtggtcagccaaaattaaacaatgatgctacgaagaaagattaaggaaggatattatcaaacagccccaaacctgccagtccttcatggtttcactgtaaatgctcaggtacagccaatacttatatatgaattttaataatcaatatttaatgaaaatgccgttcttaaatttatctcatatttgtggtagaggagatttacaaaaaaggcattgttaacattagttaaaacacttatacaactgttgttaaataaaacttctgaagtcatatagttatttatttacttgtataaaccatcttatcatattcttttttggagctgtttacatatcttttaatctctgaactaagaaattaaaattgtatttgacaacaattagtgactcaaattataattaaaatatatgttgttacacacctcgacaagcaagcactcagaaacccactttatattctgtttctattaggatactaattatggcactattccaaaaaaaaaaacaaagaaacaaagtaattaactcattgcaaacacaatactattaattttaactccttggttctcaataaaatttgagctagtaaccacgtaattaattattaattgctcagtgcactccactatgccaagttaattatcaagaataacttggtgtgacttttattatgaatggataattacaaccttgtttttctagaattatcaggattttaaacatgaaaataataatgaaggtaaagatataggcattgctcttaaatatgctgatatgctaatcattatgaaataataggatgttcatttttataatagtatcattcttatatagggaccaagacaggatagaaaagtacttagaaagtactaagctaaacaaataagttaacaaaggatgaatcttttatatataatgatatatattcgtgaagtgaaaggccaattcttagttagacattagttttattccagcctaggagaattctcattcattcccatgctctaccataagaattacaaatatctaagtacatgtatgtataaacatttgctgaacctattttggttatgcattaaataatctttaaatgtgaacacaacagtaaaacatatgttttgttttcatcaattttatttcagttactgagtcagaactgcccaactgaataaagttttgtaaacatatagctttatagttccttaaatctaaatctactctaattttcaaagcacaaaaaaatacaaagcttatcaaatatcctactaaaatgttcctttgaatctatggtctcccatttgtttggtgatcaagagctactgttcataatttcaaagaatcttgaaataacaaagtggaaaagtgcttgaggaagagaccaggatacactgacaagtagctcagagtgctaatggcaagggtcagaatcatagctgtattatgcctattttacttatgagaaaattgaggttcagctaaaacttgccaaaaattcacacaatcagagattgatggagccacgattcaaactcaggtcaatctaattccaaagccaagctcttaactgtgtctgagactcacttatccctggaaaagctacaaatctggctttctcctgtcaatattcgacacaaaatgaaggcaacctttatacaagtggcttttatttctttctattcttgtccttggttcaaggatcgaacactcaaggagacctaaatattttggaataggagccaggataacctgtcctcagagatgcttccttggctgcatcacctagccataagtactccctttttgcaggaaaacttgcaaccctagaaccataccataccaaacttccttcattttctgattaaaactattttgtacataatgtcccactttttttgcatcacaaacgccttgaaccattaagtacacaagtatattcctgggaagatgaattaaggtcttcatcttgttcttagaaagtatgtgtttattttctgatagcagaaataataatactttatagttttatagaatcttctcaatggaggatttttaggagcttcacatgtatattactgattgcggagtgtttttattgcatatatctcagtgggagtattggaaatgggtttttcaacatttaaatatatgccatttaaaaaatcccacttcctcttctgcttacaatctattctctgtcttcaaagtgataatattcacttaatgtcgactttggaaacacataataaaaatggtaaatgtggattttcctcactctctttttagctaatattgtggcaaatgtcttcttccctttgtaagcaatattttctctcttttctattaagctttatttgcctagtttagcaggttttatttttctcctgcttatcgtattcctatccatgcgggtcaaaaggaaattaatgagctcttgtttcctctgacacaaaacatttttcttggtacacagttctgcctccccagtgttttcactctggacatgacggaaacagtgaaaagcaataggagatgggagaaggcattgcattcgcaatcaacatatggtcagccacttccaatgagttttcagcactgatgaacactatcactgctgtcttaagcttatgctggtgtccattactgtccactggctgctttgtgaaactacatctcctggctttcttcatacctcgatggtttttgtgctccttttcagggttattccttacccagtcactaaatgcattaaaagtacctcataaaacaggatgacttcatgtcctttgcagggacatggatgaagctggaaaccatcattcttagcaaactaacacaggaacagaaaatgaaacactgcatggactcactcgtaagtgggagtggaacagtgagaacacatggacacagggaggggaacaacacacactggtgcctgttgggggtggggggctagggtagggatagcattaggagaaatacctaatgtagatgacgggttgatgggtgcagcaaaccaccatagcacgtgtatacctatgtaacaaacctgcacgttctgcacctgtatcccagaacgtaaagtataataataattaaaaaaaaaagttcctcaaagatttgtcctgatcaatcttctacctacagtctctctttaggttattgcacccactcacataactttaaatattatttacatgcctaggtatcccacgtatgtatcttggtcacagatatttcatccacgtttcatgtagatgtttcagatgtatctcaaattgaatataaatctagaaaggtctccacctccaaatctgccccttcttttctgttctccagctcaatattatctaatatgctcagggatcatccctgacacttcactgtctttcaactccactttcaaatctgtcaaaagttgctactaatagctccattaacataagtatcaaagacatgtttatttccacttccattgccatctcaaggcttggtctatgctttggtattctaagtggccattctgttttcagggaggttccctaaagtacattgttttcagcaaaaacaatgattatgtcactaccttgctgggtgaggtggctcatatctgtaatcccaccattttaagaggatgaggcgggaggattgcttgggcccagtaatccaagatcagccttagaaacttagaaacgtaacaagaccctgtctcttcaaaataattgtttaaagttagccaggcatagtggcaaatgcctgtagtagtcccagctacccaggaagctgaggtaggagggtgatatgggaggattgcttgagcccaaggagttcaaggctgcagtgagccgtgatcatgtcactgcactccagcctgggcaacagagtgagattgtgtcttgaaataaataaataagtaaaacaaaatttaagaatcaaaaaataaacttgtaatggttttccgttgcacttagataaaatctatacttatttttgtggcctacaatgacttgtacaacgtaaaacttgccacgctctccctctctcaccataccccatacacaagggctttcttttagaatttcgaacattccaagatctctaccaacatctcaagactttgttcatgtgactccctacactctttactgagttgcaggtctctgcttcaatacttttcctcacagataattactctcagtctctagactgcagcatttctttttgttagaatatctcatagctccttatacttttcattcatagcacctactgcggcttgtaaatatacactcatgtatatgattattgccttaaaatacattttcccccactaaacattcagctccaaaaaggcagaaacaatgtgttctttgttaatttctgtagagtttttgagacaggatcagaattactatatgttgaataaatgaatacagaaataaaaataaagattatgatgcctttgctcactgatatatagtgccatatatatatatatataaacatatataaataaatatataaatatgtgtatatataaatatatataaatacaaatatataaatatatatatataaatatataaatatatatataaatatatataaatatataaatatatataaatatataaatatatatataaatatatataaatatataaatatatataaatatatataaatatatataaatatatatataaatatatataagtatataaatatatataaatatatataaatatataaatatatataaatatataaatatataaaaatatatataaatatatataaatatatacataaatatatatagatatataaatatatatatacataaatatatataaatatatatatgtttgtgtgtgtatatatatttatattcaacggtaaatggtttataaaactttcccgatcgattaagtattggtatggagtcagagaagtgagggaaaacagttttatctaccatctttgagatatcatggtgagatttaaggatacagagattaaatatattgtccaggtctttaagaacctcatagacagagtttatgtgtgactctaaaaaatagatgaagataagaagataagtatttaaatgaaaaaattgaggcggccaagggtttggggagcttatgactgtctttaaccctatcgacactaagagaatagaagttgcttactaactggtcacttagctgactgaaacagcttctctctttgtaggaagtttaagttccacaattactcggtgccaaaaaatactgtgtgctattcaaatttctggaggatgaaaagctacatagggcatatggcagaacgatgtaaagtgcagaatatgcttagctgaagattgtcccaaagctcttgggagatgtttatttggtgacaatcgcattcactttatattgtcagccctttgttagatcatccttactcatcagggtctgatccttgctttaattgtacttagggaattatttatctctatatcaatctaaaattgatttaatcttttttttttttttttgagatgtagtctcgctctgtcacccaggctggagtgcagtggcgtgatcttggctcactgcaacctccgcctgctgggttcaggagattcttctgcctcagcctcccaagtagctgggactataggcgtgcaccaccaagcccggctaatttttgtatttttagtagagacagggtttcaccatattggctaggctgttttcgaactcctgacctcataatctgcccgtctcagcctcccaaagtgctgcgattacaggcgtgagccaccacgcctggtcaattgattttgtcttacacaattttctcttctgggcatcactatcgttcatcctcatcttctttttcctctatgtttaaaaatgaaaactcttctgcaaaagagtttattaaagcttatttattctttgtttgtttttgagacagagtcttgctctgttgcccaggctggagggcagtggcatgatcttagctcactgcaacctccgcctcctgggttccagtgattctcctgcctcagcctcccaagtagctgggattacaagcatgcgccaacacgcctggccaatttttgtatttttagcagagatggggtttcaccatgttggctgggctggactctaactcctggcctcaagtgatctgcccacctcggcctctcaaattgctgggattacaggcgagagccaccacacctggcctattcttttttgttttatataagaagtgtagcatataataatgtgtggtggtgtggtagagataagaagtggtttttgaaaaggaaaatgatcacatatacattattcacttgctagttatgcttactgggtatctacttggccaaacaatgaatcaagtaacgaaaatgtaactgtcattctaaagaagttcacagtgtgtatgttgtttgtacatgtacagagtcatagaggtgagagagatggagaaaagtgatttaataagtaagtacacaaataacaaataacatgattcataatgtgaagggtgtttatatccacaatggaaatggaaattggtgagtaccaatttttattagatgttacccaccattgcattacatgcaattgttccatcttaaccatatcagctgcactaaacatggctcattactgctcactaataggaatacagatttatatcagcaatttgggcacatgggcttgtcttttttaactgtgggaaaatatacaaaatatttcaaccattgtaagtgtatacagttcagtggcattagatacattcacatggatatgtaaacatcaccaccatctatctccaaaactcttcatctttctaaactgaaactctataccaatgacacaagaactgctcatttcccctacccctccctggtccctggcaaccatgcaactatttgtctaagaatttaactactctaggtggaatatctccaaagttcatccctattttaggatgtgacagaatttcattcctttttaaagcagaatactgttctgctgtatggatacaccacgttttgtttctccattcttggtcagtgtacacagtgtacatttgtttctaccttttctctacagtaaaatatgctgctatgaacttgggtgtacaaatatctgtgtgaatacctgttttcaattattttgggtatatacccagaagtggaattattggatcatataatagttctttgttaaattttattttaagaactagtcttgtagtttaaaaataaagttttattggaatataatcacactcattcatttacatattgtctatggttgcttttgcaaaaaaaaaaaaaaatggcagagtttaatagttgtgagatagaccatatggcccgcaaagcctataatatttactatcttgttccttacagaataagtttgctaacttctgtcttacaaaattgcagtagcaattccttggtttcacatgaaacatatgtcttcaaacagttaaaagacctttcatgttgggaaatagaaacaggataattttattctcggcctacatatgagaaaacaaggaaagtgctgaatgccacatggaagttgcaatctcaaaggaagttaatccaatattaatatccagacctcattgttgcagctaaatctatctcatcacaaatcacagagttattttacttctttatatgctatatagaaaactcagatatactttccctatatcaatgcgatgtttcatgctttcttcttttattgaagatggggtgggaatactgcatcaagtgagagacttgagtctgggagaggctgagttgtataactgtgaaatcatttgtcctccaaaagcttggatttaaaatataacagattcacgtactatgtatgactgaaaacatacttgcctggaatgttaaagatcagggtaattttctgtctcgttaatctaatattgacagtggagtataaaagtctctcactattactgtgtaggagtgtaagtctctttgtaggtctctaggaacttgctttacgaatctgggtgctcctgtattgggtgcatatatatttagaatagttagttcttcttgttgcgttgctccctttaccattatgtaatgtaatacccttctttgtctttcttgatctttgttggtttaaagtctgttttatcagagactaggattgtaacccctgtttttttttttattttttttaattttttatttttttgctttccatttgcttggaaaatattccgccatccctttgctttgagcctatgtgtgtgtttgcatgtgagatgggtctcctgaatacaccacactgatggtcctgactctttatccaatttgccagtctgtgtcttttaattggggcatttagcccatttacatttaaagttaatattgtcatgtgtgaatgtgatcctgtaattatgatgttggttagttattttgcctgttagttgaggcagtttcttcatagggtcgatggtctttacaatttggtatgtttctctcagtggctggtaccggtttttcctttccatgtttagtgattccttcaggagctcttgtaagccaggcctggtggtgacaaaatcactcagcatttgcttgtctgtaaaggattttatttctcctttgcttatgaaacttagtttggctggatatgaaattctgggttgaaaattcccttattgaagagtgttgaatattggcacccactctcttctagcttgtagggtttctgcagagtgatccactgttagtctgatgggcttccctttgtgggtaacccagcctttctctctggctgcccctaacattacgagcaacttcagccaagtctcagaatacaaaatcaaagtgaaaagatcacaagcattcctatacaccaagaatagacaaacagagagccaaatcgtgggtgaactcctattcacaattgctacaaagagaataaagtgcctaggaatacaacttacaagggatgtgaaggacctcttcaaggagaactacaaaccactgttcaagaaaatacgaaaggacgcaaacaaatggaaaaaacatttcatgctcgtggttaggaagaatcagtggagtgaaaatggccatactgtccaaattaatttacagattcaatgctatccccaacaggctaccactgactttctttacagaattaggaaaaattactttacatttcagatggaaccaaaaaagagcttgtatagccaagacaatcctaagtaaaatgaacaaagctggaggcatcatgctacctgacttcaaactatactacaaggctacagtaagcaaaacagactggtactggtagcaaaacagatatatagaccaatggaacagaacagaggccagaaaaataatgccacacatctacaaccatctgatctttgacaaacctgacaaaaacaagcaacggggaaaggattccctatttaataaatggtgttgggaaaactggctagtcatatgcagaaaacggaaactggaccccttccttaccccttatacaaaaatcaactcaagatgcattaaagacttaaacctaaaaccgaaaaccatcaaaaccctagaagaaaacctaggcaataccattcaggacacaagtacggggaaagactgcatgactaaaacaccaaaagcaacagcaacaaaagccaaaattgacaaatgggatctaatgaaactaaagagcttctacactgcaaaagaaactatcatgagagtgaacaggcaaactacagattgggagaaaatttttgcaatctatacatctgacaaagggctaatacccggaatctataaggaacttaaacaaatttacaagaaaaaaaaaaacccatcagaaagtgggctaaggatatgaacagacacttctcaaaacaagacatttatgcagccagcaaacatatcaaaaaaagctcattatcactggtcattagaggaatgcaaatcaaaaccacaatgagataccatctcacaccagttagaatggcgaacattcaaaagtcaggcaacaacagatgctggagaggatgtggagaaaaaggaacgcttttacactgttggtgggactgtaaactagttcaaccattgtggaagacagtgtggcgattcctcaaggatacagaaccagaaataccatttgacccagcaatcccattactgcatatatacccaaagtattataaatcattctcctataaagacacatgcacacgtatgtttattgcagcactatttacaatagcaaagacttggaaccaacccaaatgcccatcaatgatagactggataaagaaaattggcacatatacaccatggaatactatgcagccataaaaaagaatgagttcatgtcctttgcacggacatggatgaagctggaaaccatcattctcagcaaactaacacaggaacagaaaaccaaacaccacatattctcacccataagtgggagttgaacgatgagaacacatagacacagggcggggaacatcacacaccggggcctctcaggggatggggggttaggggagggatagcattaggagaaatacctaatgtagatgatgggttgatgtgtgcagcaaaccaccatggaacgtgtacacctatgcaacaaacctgcccgttctgcacgtgtgtcccagaacttaaagtataataatgaaaaaaagatcagggtaaaatatattttgtcattgttttgaacatagccataggtaggatcataaaatagcacaacttaaatagaaaaataaatgattcagaatcaggtctcaggtacaaacagccaaaataattcaatgaaattatttctctatactacaaattgtggactcacatggcatcatatctgatataaataatagtttattttaaatgaatatagacaggagtggctggaaactaaaagcatgtatttcttctccataagatgaaagaggatttaggatacacttaagataacatactaaatcttgttttgccagtgtagcttctgcttggcatttaaatatctgttacttaatagaaacattcaattttggaccctaaaatatcacacaatattattcattaaaattatacctactcaaatctgtctagccatatcatatagcgactgatatttttagatcaaacccacaagtgtgaaatatttttcattttaaagactcttttacatttaatatgtattcatgctaactttttaaatttaaagcaccttctatgaaatgtattttaatacaaataccctatattgtataatttacttcaacgttgtaaattttccacgacgatgtgtatcattcacaaataatatgaaatataaaaattcacttaaacatatataaaattattggtatatttactttgtactaaatgtaatgggatttgatattattatattaaatttatattcatgatgaatataagtaaacattgagtaagaaatgttttaagaaatttgctatctgcatgaatgactattcaatacatttttattgaacatccatcgagttcgttgcgatgaatacagttttagaaaaaatactaatactctggcttcgaagactgctatgtattgaaggtctacaatgctttgaatgctgtaggaagacaagataaattaggacttttgatcaccgtcccataaaagcttataatttgtctaataaggaatagccaacaattattacaataggagacagtaaaaataagtagaatgcaatgttccagatgttcagaggagttggagatcatctccttatgggttggtcaagagagccttaatggaaaatgtagcatctgagcagggcatggaaggatcatttagtggatattcctctgtcccaaaattttttgtctgtccaatatcccttctgtggtgaagaaaattagtactctttggatatcttggtattgatttcattatgtttctcatgttcccttgaggtttcgtgagtgcaattgtgattgaatcctggaaagtgggaaagtgtaggaagtgatgcatcacttcttgcctgaggtacttgatagttagtgtcaatttctcagctctcctttgtcaatacctctgaagtttcaatgttgacatggcagagccacaagatgaaagcaatttaggtccctgagtcactgtgaaggaatgctacctgatttatatcagactttatatgagcaataaataagcattcattaggccactttgatttcagggttagtttttttgtggcatctaacattaattgttctgaataagtatctccactctttggtgaatggtaccctgcttttccttggatgaaattactcttccctcattctgcatgatcttagggggacctataatcatagtgctctgtaaactctataaactggtgggacaagttcctaatttatgccaattacatttagaaatttgaatctagaattgagaaaggtagagtcagtacaatttgaagctgaagcattttaatgacagcatccaaaaagtaacttccctggagttcctgactctcagtgctgccctccctctgccacagttgccttcttttccttcatttccaagaactatacattatccctccagtaagtttcatttcacttcagttaaatggagatggcttctgcttcttcgaatcaaagcttcctaatgtttacaggtggtgaggacttttatatataaaattacactccaaagaagtatggaataagggtattttagagaaaataagtacattttgctgtagagttgcatagagatacaagtgacagaagctaagttagggtttataagtgccagactatgaattctggatgttagcctctggcctaggaggttagaaaatcaaatgccttcaggggacacgtgggacacataaaattgtaaagccttagaaagtatagcaataagtgctaaactgatggtgttgatcagtccagtctctgcccggtttcattgccttttaatgttccttgcaggtcaaacaaagcagccaagcaaaacatatccttcagctctcttttctcctggggctacccgtttgaaatcaaagctatcaacagagaaacactgaaggttcctgtgctgggaaatgtgaagcaggagtgctgcttcagaaaggttaactctttcaaaagaaacagtgatttgggtggagagagatctcttacaaggtatctactgacttgcgattgatgtccaggagaatgaaaagggagggcatgaaaacataaaaagtgtacagaatccagtaaatggcaaaatattcaattaaagtgcagggaggtataaagaaaggacaacacatgttttaatctgaggacattataagaaataatggtggtatgttcttggaattgagaagcctaactaagtcacaggttataggaatcaaagtggtggtgctattgacttggtaaatttaagagaactttataaaatttgtgaattcgttatttctttatcttaaatgcaatagcactaatgcctcaaaagaacaacctacaaatgtctacccacagaagttatacaggctattttgtttcaatgaatggctggcccgagaaaatggttgcactcaagagagaatgtttgcgactgtttttggaaattcttctgtgggttgggtaataatacactcaagagacatgtttgtgatttttctgggaaattttttcgtggagtgggtaataaatagagcagaatattaggtgagaaatactcaatttcaggactagttattttaaactgttgtaaattataatattaaattataaaatttaaacattgtgaatatgttctttttctgtactcaggtattaaatcaaatatttttgggtaattagtggaaggtgagcttataaaaagattgatagcaaataaaacagtaactgcctcaactccagggttacttgatacctaagggctaatccaaacatgatagtatctttaaatacataatgtagacccataaactagtatcggaatcaaattacaatgtttttattgactttcttaatgtgtgtaatcacacggagatcatattattcacaaaatgaaagttagtagtttgtgagtgaaagaaggcagaccagaaataaggtacatacttcatgattctacttttataaaattctataaaacgcaaacttatctataatgccagtcagcatcagtggtaacctgggaatcaagggaggggcaggagagagtgattaccgaaaacagacttgtgaggatattggatatgtttattatcttgactgtgctaatagtttcactggtatttgcatatgtcaaaacttatcaaattgtactatttaaatgtgtagcttattgtatatcatttataccacaatgaaattgtttccaaaaaggactagcttggccaatacactacctaaatgcattactaggtatacaagttttacttaaaaacaatatatgtctcaataagtataaagattaccgtagcgaacactgtggtgtgccaccgagattcaccaattacaaatgaagcattcattctcccagttgctgggattgttatctactaacagatcatacctaagctcttccaagaaatttctctcagcagacaggcacttctttgaccaagatgatattgcccggaagctggtagttgggaggctcacatctaatgactaatggattagggatacaatggtccaccttccttgcttcatacggtaatactctaaatggtcatcccaaccccacatgggaccagataagatcttccatttcactgcatcatcattcaactcctctctctcctcaatcctgctgcctttactccctcccaggcatttttcttaaaagcactcactaagaaaccatctgcatggaaatctctgtcttagagtctatgtcttagaaaatccaatctaagataacaacctaatatgttgagaagttaaaatgtagaaaacagaaatacatatctgaagtaatcatttaaataacattatgaaaatgtacatcagtatttataaatagccattatatacaatgatacaattttgtttatcatttcttcaacttactgctagatttcagggaaaaatacaggatacaagtacttaaagaaagctcaagaaggagatatggctgattgcataatagaatattttgcagactgtcaactattgaggacgctggcatgtttggaagaataactgttattaaattttagaacataaaggtacaacatattgttatcaatcttaataaatccattcagcatttcagaataacatgaaaatatgccaacagaaattccattttactattgttactatcaagaacttggcaaaatttggttttttactttgtgaatgtattaaatgatacaggtaacatatatggaattaactatatgctaactgtagcaggtttcacttttcaataaacgaaatagccgtgacaattctgtctttaggatgaagagagagcattttccatgaaaatctgaattgattttcactatctaaagacatgaaacacatatgctagctctggacgacaaaagaagatgaaaatgtcctctataggaaggccatccaggatgttgaatggtaagagacaacttccatctaattatagacacattaaaacatggtccgttaactacaacccttatcctttccctttctaccaaccctcatttatccctcagccattgattttaaaaaatattttatatatttgacacccaaaggaaaaaatgtaaatgaaactcacttccaagagactactgctctcagcaaaccaaaaagagaataaaaaacaaatgtctacaaatttcttcaatgtagaaaaacaattcatagatcttaaaggcagtgatagggtttggctgtgtccccacccaaatcccgtcttgaattgcagttcccataatccccagatgtcatgggagggatccagtgggaggtaactgaatcatggggggtggtcactcccgtgctgctgttcttatgatagtgagctctcatgagagctgatggtttcataaggggcttttcctcctttgctcggcacttctccttcttgccatcatgtgacaaaggatgtgtttgcttctgcttccacagtgattgtaagtttcctgaggcctccccagccatgcaaaccagtgagtcaattaaacctcgttcctttataaattacccagtctcaggtagttctttatagcagcatgagaacagactaatacagtaaattggtaccacagagagtgggatactgctataaagaaacccaaaaatgtggaagcaactttggaactgggtaacaggcagaggttgaaacagttgggaggactcagaagaagacaggaaagtatgggaaactctggaacttcctagagaattggaggggtcagaagacaggaagatgtgggaaagtttggaacttcctagagacttgttgaatggctttgacccaaatgctgatagtgatatggacaataaagtccagactgaggtggtctcagagggagatgagaaacttcttggtaactgtagtaaaggtcacttttgctacgctttagcaaagagactggtggctttttgcccctgtccgagagatctgtggaattttgaacatgagagagatgatttagggcatctggtggaaggaatttctaaacagcaaagtgttcaagatttgacttgggtgctgttaaaagcattcagttttatgtatccacaaagatatggtttggaattggaaattatgtttaaaagggaagcagagcataaaagttcagaaaatttgcagcctgaagatgcaatagaaaagaaaaactcattttctgaggagaaattcaatctgactacagaaatttgcatatgtaacgaggagccaaatgttaatcaccaaggcaatgggaaaattgtctccaggaaatgccagaagttttcatggcagcccctcccatcataggaccagaggcctaggaaggcaaaatggtttcctgggccgggcccagagcccccctgctatgtgcagcctagggactaggtgccctgcatcccagccactccagccatggctaaaaggagccaagatagagctcagcccatggctacagagggtgcaagccccaagatttggcagcttccatgtggtgttgagcctgtgggtacacagaagtcaagaactgagctttgggaacttctacctagatttcagaggatatatggaaatgtctagatatccaggcagaagtttgctgcagagatggggccctcagagagaacctctactaggtcagtgcagaagagaaatgtggggttggagcccccacatagagtccccactggggcactgcctagtagagctgtgagaagagggcttgatccaccgtgtgcatggaacagccacagacactcaatgctagcctgtgaaagcagccaggaagggggctgtaccctgcaacgccaaaggagtggagctacccaaggctgtgggagcccaccttgcatcagcgtgacctggatgtgagacacagagtcaaaggagattatcttggagctttaagatttaattactgcctcattggatttgacatgcatggagcctggagcccctttgtttgggccaatttctcccatctggaatgggtgtatttaaccaatgctggtacctccattgtacctagaaagtaactaacttgcttttgattttatggctcctaggcagaagtgacttgccttgtctcagatgagactttggacttggactcctgggttaatgctagagtgagttaagactttgagtgactgttgggaaggcattattgtgttttgaaatgtgaagacgtgccatttgggaggggccagggatgaaatgatatggtttggctatgtccccacccaaatctcattctgaattgtagttcctgtaatccccatgtgtcatgtgagggacccagttggaggtaattgaattacaggggcggttatccccatggtgctgttcttgtgatagtgagttctcatgagatccaatggttttataaggggcttttccccctttgctcagcacttctcctttctgccaccatatgaagaaggatgtgattgcttccccttctggcatggttgtaagttttccctgaggcctccccagccatgtggaactgtgagtcaattaaacctctgtcctttataaattattcagtcttgggcagttctttagagcagcatgagaacagactaatacagactgtatgatcaatatattttactttctgagtttacttattaatgctaaactgtatttttacctttttacttttgaacgccattgtcatattaataagagaatttttttgaccaaagcattttaagttctgtacacttgcagtatttgatctacagatttacacatcatggacagaaatgttatgaaaatcatttacagaattatttaatggaaaacgtttcatatttaatatattttcatatgttgtacatgtaagaaatctgattttatggccattgataagagcgataatggcagccttcatataagatacatttctgtctttttatttttgattatacctgcaagaagacacatggtcctatgcagccaataaatagttgtataataataaagttatgataataaatgtttatacctttcatgttttacatacaccaccaaatgcaaaggaactatgaagcagtttgcactgagaccagttaaaacctaaattctcccctttagctatgcggtgatctatttcctgctacatacaaaatcctgaaaaaatggggctggaagtaattccagtgcttttaaacccaatctacaatttaatttcctttgtgacctttgaaacatcactgttatagaagttccaccattcctaatgccccagatttgccactgttgtttccttattaagaagcaaaacaaagtaaaacaaaaaccttcacataattttgagttctctttcttctcagtaagggaaggattttcacttaacttcacttatctcatttttctgtgttcttcaaccttaaactacatccagccttgttcatgtctctcttaaactttcttctttatacatttcaaaagctttgctctttttctgtcatctaattgggctagatctctattcatattactctttatgttacaacctattaaccaaaatattttcatgtggcaaagaattctgatcatgaggcaaaatgaactaatgagaaaaatttgtcttcatttctagtgaaaactaatttattcttgctttctctagggatatttcaagaattgtacttttggtcttttaggactttgaaaatgttggaattggtagtgaatttctaaccaaaactgtgcataaagtcagctgcttcaaagcaagtcatagaagcctccagcaattctgtgaccaaagaaaagtaaccctaatattaacctttcctttgactttaaagacaataatttgaataatttccaggagacttgaaaaaatcttcacacaaaaataaagttttgttaaatcaatactttgagaaatacccccaaattatttctatattggtgatagtaaaagacaaattcaagtattttatgtcgttcaagaaattggcttgtgtaggattgtgcacgtgacctttaatttccacttctaattttgtcactaactgttatgaatcacacttaaaaaacaaaccatggctatgatctttttaaagctgtaaagcaagactcaataattcacagagctaaccaaaggtgagtacataggaatatcaaaggtatacattagcaaaagattaaacaagtaagtcaataaggaagaaatagaaagacacagccacacaagcctcagaatacaaaagctgatggtgaatcaggatccagaggaatgcaggagtcagaaaagtaacacaaatacgcagaagagtgaccagctggatagggaagtgcagtggcccttgctagggtaataatgcccctccctcacattgccacagatccaggtggagctcacccattatcttgggcctggacactccagggtactctggttgatgtcctacagccggaaactgcatgtcttagcctaaagtctatctttgacgcagaaaaagtagctacaaccacatgcaaaaacaggttggaagtagttgcaagaggaaattaataccctgacaccctgagcggccctttaaaagtgactaacaagagttgaaatataaacacctcagctcctgcaccttgtctaagataactctgagacaagtgttttatgccttcccagactttctccagggaattaagccctagttctcacagtggtgtttggcttgataacatactctttacaggttgctttctcttaactttctcacaactccaacatcctaccacagcttcctagaatcactgcccaaagaaactatttgaactcacatccttgtctcaggatttgcttatgtaagaacccaaactgagacactcataatgcaagaatttatattattaataccagaatcaatccttaagcatggctagtttgacactctacatagaggtaaggaaaagcacttaactggagcagaaaattcactcattcttttgaaaaatgaataaggtactcttttttgtaatagagagtgagtgtaatgggatacagacatacctaatagtagtgttacagtagatagctagtcagatatgagcagggtaggagaccccccacccccgccaccccaaccaggaatgtcaggcaaccatcaagtgatggtcagtcaggtggttattaaactgtgtctttaaaataataattggtcacagccaataccagggaaaggcagtctcccaatagataaaaacacctgaaattggtgatcagcagcttcccgataagatcgcaggagttgggcaaatgggctcccgcgtgcgcactaagaggcaaaatgtcatagtgtaactggtatacgaccttcctctggaaacacttgactggtaagggaacacctcttgaatacaactccagtaaatacaccgtgcatgctcccctcccaagtgtcagcagaccactgtgcatgcagatagccccctaccccaagggaagaattggggagaaggtatataagaccatggaagtatgccaaaatacaaaaccataaatcaaagttcaaacaggacacttaatatctcaagtcgcccacttggcccccttccagatgtactttatttcctttcatttctgctctaaagtttttaaataaactttcattcctgctctaacacttgcctcagtctcttcttctgccttatgcctccttggtcgaattctttcttctgaggaggcatgaattaaggttgctgaagacccgtatggattcactgccagtaacaggaggagagagagttattcaacgaattattatataccgactatatagtaagtgaccttactcattccggctcaccatcacaatatgagtattagggttcaaaggacaagcttttatgaaatgtaaatctcttaatataaagaattaaaataatatccaagtattagattctaaataaatacttttaaaactagttattacaagactgtatctaatcacaaacaggtttttattttgttttgtttttctcactatctcaagctgctgaaacaaatttaatggagtccttccctcatcactgaattctgtagatttttctttcagttgtaagaaaataatgctttccttttgaagatgttggcttggattagaaaaatgctttattatgagtattgcaaagctacttatttaccacagctagacagagactctttcttactttgtcatgcagctgcttgtttttaaacaaattttgccaagagacataaaccagatggtcttcttcaagggtatcctgtgagctgtgatagtcagcttatggtagttttgagcagcagacagctgggtatggaaagtcatgatgctatttggaaatccaactaccaagtgtgctgaagcacaaggagattctcaagtcagtaaataataaaattgtgacttaaagtttgtttcagtattctatttttacagggggcattaactttatgctttataatattacttttctgggtaaaataaaagtaccccaacacattgaattagaaagaaaacttgtgaaaaaatggattcagaatacctttccaagtgggatcaacaaattgtaagttgggctttctaacagagttgtctgtgttttatcaaaaatgtttaattaatactgtaataaaattctactagaatggtgtggtatttcaagttgcaagtctcagttctgttttgtagtagtgttatacacccacactcttgaaatgggttcactaactgccaagtgtatttctctatccctgatctttggatatgccacgtgacttgctttgacaattgactatggatggaagagagaacgctagttataaatctgggtcttaagaaccatcatgtgtttctgcttacccttctgagatctttagaactcagccatggaggaatgtgccccaaatatctactgccattccagcttgagccccagaatgagacacatagatcagacatgtttggtcaacctacagtcagattctgaatcagagattactcaaagtaggcctgtgaatatgaggataagtgcttattgttcttttggggtatgcttgtcacacagcattattgtggttgtagctgactaatattgattgactttggtgagggcccaataaacagctaccttgggtcactcctacattactgagagataggggaaagaaaatgagataaaaataaaagttagcatctacgtccttatcaggatgctactattttatggaaggtacccaaagaaattccagaattatatctctgatgattccaaaattccttcaaaacaaaggacacagactggaccatccttggttttcaagtactatgctataattttgaatattacagaaagacaagtgaaagaactgaagaagaaactaaaaaagcatttcaagacaaacagacaaaatttgcctttttatgaacaaagatagtttaaatttattcaaacatataaattactcaaaggctaagaattttcaaatgtgcatctaaattgtcatttcctacaagtatctagccatactaggaaactacaaagaatattttaaaacttgtatttcaggcagaaatctctcaaaaaaccacatctgtggcttgtaatgggcagttttcccttgagaacactgatattttcaagaggaatttgagactatccacggataaactaaaactaatatgaaaataattcttgtgaaaattgccttacaggcaagaatttgcaactttcatagggtaaacagatttttaaagcgttagaatttcataattgtgacaaacatcctcctagaatagaaggtgaaacaagcaagtaagcagacaagcaagcaagcaaacctttcaccagaatgttatactgactttagtgactaatggatatatttttctctatgagagactgttcatgtatctccaattccctaattagaaaaacatatatccaggtcttagattattttatatattgctgtatccacacctaaaagtcatgatttgaccttagtatagcgaaatgaaaggaaatataaggaaatttaccctgcattaataatttattgaatacactatgatggaaatggagattctgttaaccaaagagtttctcaagaaacttattcattctagaatattacagcttttgagtgagaagcttattatatacatttaagggctcatcaataaaatattaacatgtattgaacatctaacatgaaaccatactgcattccacttaggggtgacaaaaggtatatagtacagcctcttccctgtaggaaaaagtactccactgaatggtaacatgttgcaaacagctatgtaagacatataaactcatgataataacctgtaagataaataggtaaacagagagttctatgaatccagacaatggaataattgatcaagaacagagaaggattccaagaggtggtatttgcactgaatgctgaatggtgtgtaggaatttgctaaggagcaagtcaggactcctcaagcacatcagaaaatcctttaccacttggctttgctaagcatcttgtaatgaattacaatccatttctgctactgatctcgaacataaagatatcaccttcaaaaatttaaacatctttttaaagtactttggtcttgtatatgagactttaaaaagtcattatacgtatttgtgttgtttctactgatgtctatagatctggaaggaagaacataatccttgagcataagaaatcctatgtgaaatgccatggaggcaggctatgtagtggaaaagaattcataactggggtcacgatatagactctggcacatacttcatgtgtgagcttaagacaattatttattctaaaactcaaaattattcgtctctaaaattaaggttctcttgagaatgaaatgatatatgtaaggctctgaacccatgcctggcacataggtgtgcctaaaaataagctcttttatcttatgcaaggtccatcctacgtgtccagaaaaagtaatgtcttgaaatttcagtacattgtcataatatcagctttaaacttaggtccttgttttatagtggttagtcagtgaattagtaagcaaaacttgctaattaaatttaggtaacttatataacttaggatccaactttagtaaaatttaggaaagcattagccctctaagtaggagcgctatgacaaccaaattctccatttctcacatttcctaagcagtagcttaaatctaagtcagacaaaagttgatgaatgagaaattactttgagaatatggagaaacagaagagtaggtacctagggaaatgatgaaaacttctactcttatattggcagaatttagtaagccagagtaagatgcgggctgaatcagagttcataaaattaggaaagaaaaaaaaagggaagggttaactaaagacaaagttgccctttttacactcttcttagggctccttaaataaaacaaaacaaaacaaaacaaaacaggagccgggtgcagtggtgtgcctctgtaatcccatcttctcagaaggctgaggtgggaggattacttcatccagggagtttgagaccagccccagcaacactctcactcaaaaaaaaataaataagtaaaagaaaaataacgctctttttaaatatacatgttgaagactgttagttctcttccaatattctttttttttttttcatgactgaacagtttttagcagagcacatgtgaaataaacacatttcccagccccacttgcagcttagatgtggccatgtgacagacatctggccaatgaagcgtaagtggaaatataacatggcagctcccacgaaacttccctaaaagacaattggtatgcaccctttgacccttcttctggccttcttacatccttcttggaatgtggatgtcatgagagctccatcttgcaacatgtggatgaaattccaccaagtaaagataactcactcagtagaaaacagaaatgagcggggccaacatatctgccttggctgcaaacttccagggtttttcaggagaaagaaataggcttctcttttatttaagtcatttctaccttgagcttctgtaacacttagccaaagcaaattataattgataaaataaagagagtttctgggaaaagtacatttagcacagttttattttacagtaatgtcttttaaaactcatctattccaggtagagaaaaaatgcatatttagagaagggaaatttgtgaaatgacaaaaccaagaaatacacaatgaataaagtcaaatattaatatcagcctccaaaatgaggctagtcctatggacacaaaatttctttctgtattagagtctttttcctttgacaataataaaaatgtttatttagataacaagcaggcaaatacagtcccctcatatactgaagaacaagaatcatctatggtgaggatgaaaatgcttgtatacaactatcctgggaaacaaaaatgttcaattactttgagaaaaagactggggatattgatctatggctaactctgagattatgtgaattttatatctagtcaatttcttatctgaagaaagttttaaactaacctctaagtgaactgtgaagatttataagaatctgaaaatgttgaagatataaggcaaatgatcctggatgaagcggtgatcataaaaagcaaatcactctgcaactcttaagtgctttgaactataaataggaatatgcagaagataagctgatgggcagaaacaaacttctatttaatgcatttcaaaaagctctttcacttaataaatacaacaaattttcttctttaaattctttcaccacctgctcttaacaactaagaattcagaagaaattatatttaaaactaaacaaggaaatgtaaatgaaggctagtttagatatctaatttagacggtatagtgtgctgaatggttcatgttttttaaagagtttcaataagtcacaataagataagaatattattcattgataattggtttgttgtaaggagacgctttgatagtccaatatacattaaatacctcatgacaccaactatatggggttaatcttttgcagtttaaagctttgcctctggtagtaaaacttccatgtaattggcatcaatagtcaaatcacacaattcattttgggttgctgggtggaaacaaaatctcctctatttggctcacaatcactctctcagtggtgtgcaaaatgcaatgactggccagtgaatgatatttacaatagctagggattatcttagattatacagccttcagcagaaacataaacacttgaacagagcagtgtgaaatagaagatagtgtgtgggaggaggcaagctctaatctgaaatatacaagaagaaacttacatatggcaaaaaagacagtatatagaggctacgcttgatggagggagattataataaatgacagattaatgagacttgtttttctcgaagtttatgatggtttatttctggcatacatgccaagttgatgctatcaaattatagtgttcattaccattattatcatcaagtcgtattgattaccaatgtgcactctactgggcattatatatacaagcaaaattcaggtggtttctgacattcaacaaccaataaaataaatcagaccaaagattgtagacatatgtaggagagcgtatagtgcacaagatactcaaatggagaaaaacttaaaggttaaaaataaatttttaaatactttcagtgtttaggtgaactggtaagtgttttggtgtgtcagtttataagaacattgcttgctatatctaagggaactacttattcattattttcttaaaaatgaattctatccaactagttacttagtaaatcatgattttcaaagaagatcttgagggtaaaaaccagaacagaacatttccccataaaccatggtttcaacaattcaaaaaagtgagacggagtggtgcaagatgtcagaatagaagcctatataactaatctccctcactgaaacatcaaattgtaacaactatgagcagacagaaaagcactgtcaccagaaccaaaaaccaggtacggaatcatggtacctggttttaacttcatcttgctaaaagaggcattgaggaaaggcaggagacacagtcttgaatcaccaacaccacaccttcccaatcacccagcactggacgtgcagtgcagagagggaatctttgcacttttggaagggacagtacagctactgggggactttacattgaactaactgctgtgctgtcacagtagagaaaaaagccatgctggcctcagtcagtgcctgtgcacggagggaatatttgaactagccccagccagaagggaatcgcccatcccagcagtcagaactcaagtttcttggcaagcctcaccattgtgggccaaagtgctctggagtcccaggtaaacctgagaggcagtctgggacacacgaactgcaattcctagataacttctagtcatagcctgggctaagagctagaggactagggtggcatgtgacctagggagacaccagctggcatggctaagggagtgcttgcaccattcctcccccacctcaagcagtgcagcccacagtaacaaaagtgactccttacttttgcttaaggagaggagagtgaaaagtaaagaggattctgtcttgcatcttggataccagcttagtcacagtaggatagggcactggacagtgttgtgaggacccatttctaggctcagctcctggacaacactctccaatcaagagagatacagtgtctcgaccaggcatggtggctcacgcctgtaatcctagcactttgggaggccgaagtaggtggatcacttgaggtcaggagttcgagaccagcctggccaacatcatgaaaccccaactctactaaaaatacaaaaattagccacgcgtgattgtgggtgactgtaatctcagcctcttggggggctaaggcacaagaatctcttgaacccaggaggcggaggttgcagcgaactgagatcctgtcacagcactccagcctgggcaacagagtgagatgctgtctcaagaaagaaaagaaaagaaagaaagatagaaaaaaaagagagagaagaaaagaaaagaaaaatagatacagtgtctgaatggatgaaaaaataagacccaattttgtgttgacctcaagaagcactcttcacctataaagctacacacagactggaaataaagggatggaaaaagatattccatgccaatggaaacccaaacatagctggactagctctacttatatcagaccaaatcgatatcaggacaaaaactgtaagaagagacaaagaaggtcattatataatgacaaaagggtcaattcagcaacaggatataacaattatatatgcactcaacactggagtatatatatataaagcaaatatatatacaacactggagtacagatatataaagcaaatattattcgagctcaggagagagaaagacctcaatacaataacagcaggagccttcaacaaccccactttcaacattgggcagatctcccagacagaagctcaaccaaagtagtaacattggacttaatctgcactatagaataaatggatctaatatttacaggacatttaattcaatgagtgtagaatacacattcttcttctcagcacacagattattatcaaagatagaccacacagtaggtcacaaaagcagtcttaaaaattcagtaacaatgaaataatatcaagcatcttctctgaccacaatggaatgagactagaaatcaacaatgaggaattttggaagctatacaaacacatggaagttaaacaatatgctactaaatgaccactgggtctatgaagaaattaagaaggaaattgaaaaatgtcttcaaaaaatgaaagaaaaaccacataccaaaacctatgggatacagcaaaactagtactaagagagaaatttacagctgtaggtgcttctatcaaaaaagaaaaaaacttcaaataaatcacctaacaatgcaacttaaagacctagacaagcaggagcaaatcgaacccaaaattagtggaagaaagaaataataaagatcagagcagaaataaatgactttgtaataaagaaaacatacaaaaagtcaacaaaacgaaaagttggtttattgaaaaggtaaacaaaattgacaaatcttgagccagactaatgaagaaaaaagggagaagacccaaataagtaaaatcagaaatgagaaaggagatattacaattaataccagataaattcaaaggctcattagtggctactatgagcaactatatgccaacaaattgaaaaatctagaggtaatggataaattcctagacacatacaacctaccaagattaaaccataaagaaatccaaaacctgaacggaccagtaacgagtaacacaactgaagccttagtaaactctcccagtaaagaaaagcttgggacccgatggctgcactgctgaactctaccatgtgataaatattgatgcaaaattgatgcaaaaaatattgatgcaaaattgatgcagagtgaacaggcaacctacaaaatgggagaaaattttcgcaacctactcatctgacaaagggctaatatccagaatctacaatgaactcaaacaaacgtacaagaaaaaaacaaacaaccccatcaaaaagtgggtgaaggacatgaacagacacttctcaaaagaagacatttatgcagccaaaaaacacatgaaaaaatgctcaccatcactggccatcagagaactgcaaatcaaaatggattaacgactaaaatctaagacctcaaactaagaaactactacaaggaaacattggagaaactctccaggatatctgtctgggtaaaacaaatcttgagtaatatcctataagcacaggcaacaaaagcaaaaatagacaaatggatcacatcaagttaaaaagctcctccgcagtgaaacaatcaataaagtgaagagacaaccaacagaaagggagaaaatatttgcaaattacccatctcacaagggattaataaccagaatatataaggagttaaaacaactctataggaaaaagtctaataattagatcagaaaatagacaaaagattcgaataggcatttctcaaaagaagacatacaaatggcaaacaggtgtatcaaaatatgctcagcatcactaatcatcacagaaatacaaagcaaaactacaatgggatattctctcaccccaattaaaacgacatatccaaaagacaggcaattacaaatgctggagagagtgtgaagaaaaggggactcctgtacactgttggcaggaatgtaaattagtacaaccaaaatggagaatagtttggaggttcctcagaaactaaaaacagggctaccatatgatccagcaatcccactgctgggtatatatcccaaagaaagcaaatcagtatatcaaagagatatctgtactcccacgtttgttgaagcactgttcataatagccaagatttggaagcaacctgagcgtccatcaagagatgaatggacaaagaaaatgtgatacatatacgtaatagagtactattcagccataaaaagaatgagatcctttcatttgcaacatcatggatggaactggaggtcattgtgttaaatgaaataagccaggcacagaaagacaaacatcacacgttctcatttatttgtggcaggtaaaaatcaaaacaactgaacacttggagatagagggtggaaggatggttaccagaggctgtgaagggtagtgggggggttgagggggaggttgaaatggttacttggtacaaaaaatagttagaaagaatgaacaccacctactatttgctagcacaacagggtgactatagtcaaaacaatttaattgtacatttttaaacaattaaaaaaatacaattttactgtttgtaaaacaaagaataattgcttgaggggatgaacatcccattttccatgatacttgcatgcctatatcaaaacatctcatgtaccccatatatatatatgtaccccacatatatacacatatatatgtgtaacccatatatatatgtaccccacatatatatatatgtaccccacatatatatatgtaccccacatatatatataccccacatatatacactatgtatgtgtgtatatacatagtaaatctatttatatatagtatatgtttatatatagtatatatttatatatgtgtgtttatatatacagtatatatatatatatatacagtatatatatatatatatatatacacactatgtacccacaaacgttaaaaataacatttaaagataaaaaattttgaaaagtggaacataaatagaaatttgtacttctctgtctgtctactgtatcttcttctgcattgtccccatgactgaatccacgggattcctttcttccagtcagtaaaacagtggccatggaataggatatgaacaactttcttaagttcaggacttgcttgttttttaccccttacttcctaattctaccaagctcagaaaccaacagtaagtattttgtattggcacatatacctatacctgggttgtggaatgaagatccagtcttgcataaaaatcttcaaatatggtagagattaattctaagactgcaatgataatccttcgtgagttgtcagcatcctgtatgtgcttatcatgtatcttcccaactacatatggcattgtgacaaatagaagaggctgctaatgctgctatagctgaatgtctcatttaggaacaaacaattctggaaaagctcccagattatgcatctgtccctctagcttccactttaaaagataaaattctatagtgataacgtgaggattagtatactattctttccttatatgggtaatgtgaggttatttccttaccttgacatgaaagaaaattatttattgaatgtctcagtagaaagattacaactgagatagcaaattcttatcagaaactcacattaggaatgggcttgcagaattgcatgctcattccctactgtctgaatacagagacgattagggactttctcttcgaatctgatttatttggtttctactcctgttttctctcctttcgtttctttcattttctcatttttcttcatgtagcacaaatggcagccagagcctgtgagtgctttaatgctgcaggcttactgctatgagaactgaacaatggagaaatccctggggaagcagcttccaactgtcccaccctcagcatcctaatgacctgtggaactgtggttccagaatggtggtgataaatttggaaaatactttctctaaagcagtagtgcccacatatttatctgacaggctgtactgggcaattataaaatgttcaggggtccatggtgaaatgccaaaaatagaacaatgcggtatgcttttcctaaagctacaccttctttattaaaacaattatgatttatgtccctcctgtacttaaagtacatatttattatttttaaaatgtaagtataaattttagttcagtccagcattcacacagaaatgtgtacacatcacaagtgtatggttccataaacttccctaaaggaaacacatcaatgcaagcagcatccacatcaagaaacaaaacattacccagtccctagaagcctgcttcagcccttgttaatcacaactcacaaaggtaactcctatctgacctctaaactccaaagtgcctaattttttagtttcatataatagattcatacagtaagtgttctcttatttctgacttactttatacaacactgtgttcatattttatttttcaacatttcctttattttatgaaatattattaataagaacatttgattaattaaatgcccttatacttctttctctaatttttttagaggtttctttttttgctatagaaatgtaataatatagaaataaatactcttagtctcatgtctattttacatcatatctaaagctcagaaccatcttgaatttaactacttatatgggtgggtaagtcaacccaacatatctgactaagtagaattccaagaaggaaatactgattttaaaacattactttcttgatgtttgacagggaccttgttgttacacaataatgccatcttatggctgtacagcaatttgtagtctagaaactgccttcattttgatgatagcatttgaactgttctaccctcttagtctttgggaagtcattttctaaaagtgggaaacactcactaatggcttacaggatagtaaagatggtatcagaaagaaactaacgacaatagagtataacatctgacatttagtaggcccttcttaagtgttcattgaaagaagaaaagagctttgtttctctaatcccagatagatcttatgtaaattctttgtttttacatgtttcctataggtatattttataagcagttagttacccacccgaaaatcaatgaaaactgaatttagcagtaatattaatttcccaaaaagttaactagtaatcttacatataggcatatctatccatacgttcatggtgcttgtggatttactgttgactgtgttgactgttagtgaacaatcagaatgtccgtgaaaataaggcttttaatactttgatgatgtgtaacttgttgagatacatgttgaaattctatttgctgaaagacaatgtatggaagcaggtatgttagataatgaatgagcagtcataaattagtctggctttttaaatatcttcctgttctcatctaaagcgtaatgtctgttttaccttatgacatttaatagagatgactgaacgagaaatacgcagatgtactatttagtatgtgcttaggcaagtcacataacatctttgaaatatagttttctcccttataaaataatgaagcagggcaaaaccactaaggcattttctagctgtaaaacaatcctgttataaattattaactatctctaataatttgaattatggttcagcaaatattaacatctctccccccttccactgtaggaagagtctactttctcattctattgatgtcagatttggcaacgtaatttgctttggccaatcaaatgtcagtgaacttcacaggagcagaggccatgagtgttcttgggaggtttaggtttatactttggtgactggtcatgaaaacatgtcactgacccttcatcttaggtccagagcaaagacatatatagcagaccttaatccaacatgcatcatggaacctagctctactaacccacatcttgaagcagagcttcccggccaagcccagctgagtcagtcaaggtacaagtaacctaaacagccagaaatgcctgttgttttcagtcagcaagttctagggtgatttgtgtcacagcattattgcggtcatagctaatactaccatacatgtaccatttaagaaaaataccaatatagcccttcttactagctcaaatttattttgatttaacccaaattggcttactaaaaaactcagcagatttttgttgagaacaccacatgaaggctgtactgaacatttgtgtattcaggaatgcatagcttctaaatctctccaaggattcaagaatctaccattgtatgggacttagtaggacacgaggtgttgactgccactacaatgaagaacaaattcagctatttattttccctgatctctggcaataagaacctagttctgtggcctaaacctgtattgtaacagcagtcatcaatctatggcccatcagcaattccagcctgccatctgccttggtaaataaagttttatttaaacacaacatgtccatccatttatatattatacatggtttttttcaccctaaaacagcagagttgagtagttgtgacagagactacatgacctgcagggacaaaaatatcgactaactgcccctttacagaaaaaaatatccatcctctgactatcagatgcttctgccagagaccctagttgtagaatgagcgacacacagcaagaataaataatttagatactttttttttgcagtgacgatagcaagcaatgtccagtgcaatggtgctcctggtaaagcaatggactctggcatgacagcaaaataattcagatttacctcatagcttgatagtagatatattctggatgcctagcctgctcttcctttatagtttctgcccattgttaaacctagctctcaggctttcctattgattccatgaggtatctgatatccttctagtaatttatataattctacctaaagtaactagagtcactttctgttagttgtaactcagaaccttgaatggtctatagaccttgacttattccccattcttagtaagatagcttcattccattccccagggatcttgttcttgccctcttgtacagctccagtctatcaacccttattttactggctggttgtgccttttctctccaagactgtgaagctcttcaaagcagggactgagtctaattcttctctctgtagttctcagggaaatttgaaagcatgtaagaatgaattaacagatatcatgactatcagaaccataagatcaccattttcatcatcaaaattgccaaccttaactgagccattatcgtgtttaagcaacccactaagctccccacatatattgtgtcagataatcctcataacaaccctgtgacatagacactattcttatcctattttatacatcagaaatgtatggagcagaagatttaagagacttgctcaagggcacatagatagcagaaaggccagaattccaaaacgggttggaactctagagcctgtgcttataagcaattacttaaaacagtttgtatctgagattgtactaaaagtcataggaaatttaacagctcctgaccaattcctatagaatgtcaatggaagtacaatttcaacctctggataaggacagggtggatctattggggctagagaaactctatcctttgtcaaaaccagaaaagtcctcagagttggggtgagatttcagcgaccctctctgtggaatggcgttagtgtttctgtttaagtctaaggtgaaggtaaactgaaagggaaatgtccatatgacccagtgagaagggaatacctggatcatttgccaaaaattactcatgagtaaagcggaggagaaacctcaaaaagcagaaagcgttatttctactttagtgcaaaactggtaggtgtatatagaagcacagtaatcactggctatccaagaaacctcaacggtccttaggggatggtgtgggtggcctagaatgcttggagaaaacactgactataagaagacaaaccagagggggaagaacttcccaagagtggaatgaacatcccaaaagatggtaatgaaactgacatcattggagtagcccgcagagcctcataatgtctcaatgtgaaatgctgggagaaagtacaccatggtggcgatataagtttattcaaatatttttgttaatttattttagagagagtctgttactcaggctgtagtacagtggcacaatcatggctcgtggcagccttgaattcctgggctcaagtgaccctcctgcctcagcctcccaaagcacagggattacaggcatgagccaccattttataagtttaagtttgtatttgtagcatatacacagagtggctgagtttctttgcctttatcaagcctggctttggatactgtgggaccagctattttcaaggaagttgagataaatctgtttttttgttttgttttgttttgtttgagacggagccttgctctgtcacccaggctggaatgcagtggtggatttgggctcactgcagcctctgcctcctgggttcaagggattctcctgcctcagcctcccgagtagctgggactacaagcgcatgccaccacgcacaggtcatttttgtatttttaatggagacaaggtttcaccatgttggccaggctggtctcggactcctgacctcaaatgatgtgcccgccttggactcccaaagtgctgggattacagacatgagccaccgcacctgccctggaaggtgcagtgagataaatctggtagactatccaaaggggaaatattctcaggtttcggagaggaggcttgagtccagacacattgaacacccactttgtgctcagcactatatcagtcctgagcatataacacaaataaaacatagcccttttctataaggagcttgtgtgggaggcagaaaagtaaacaaattgattactatgtgttaggttttaggagcaggcacatcagatcatatattctacacggtagccaccaagtctggaaaatttacaaatgcataaatgatttattgatattaaattacattaaatgatgaaacaatatccaagtttccagatgttaggagcgactaatagttttaggatttctagaaaaagacaacatctgaagtgagacctgaagaacaggcaggtcagagggagtacaaaacacttgggcatctgcaaattgatttaatatcgctagaacataattggaggggcttgctatagggcaggcacgaagaaataagcagtgaggctgaccagataattttgcacaattaaggagtcagggtttcattctcaagggaatgagattatagtaccaaagctcttacactttagaaaaatgacggccactgaaagatcgttgagaacaaagtggagataatcacttgagacaactgagattaatgctagaaatctctctttaggtgcctgatgtagtaaaccaagaactaaaataggagtaaagatggttagaaatggacagatgtaagagataccatggaggttccctataattattagacgaatgatttgatttcctctgagaataattaagaagcctaccttgaggataaagacttctgaaatgaatcactttaagctgttagagaactttattacttttaatctaaaaatgtaaaagaaagagtaatccacttcttgtgatgtgaagctaaataatgtaattgaatttctgccaccccccaattaagtcaacagctaaatatttcaattaagataaaaagaaacatgattttaaatcaacttaacaaattccccatggcaaaaaaaaatgtgggggagggtaatgcaaagtgtaaagtgtcaccctccaaaatataaataaatgaaaatcaatttttttattgataggtagtattttaaacatgttaatctaagtatcaaactcctataaatttgtagatacagatttgactaaagataaatatgttatatcgaacaactgtttatagcacctcaatgccccaatctgatttacgattacctgaaattttagaagatataatgcttcaacataacgctaaatttaatactgaataatttctacagttcagctcatttgtctgaattgttcatcattatttgttctcattttacttaccatttttcaatgagagtgatacttctttttccctgtcttttttccatggagggtactgaaataaattctacagttccctgaaaacaaatcatttctgcaagtatcaagaaaaatatatgtgttacctacccttgtcggtccttgtacattttgttaactttttcccattggaaatcaagctgggagagagcttcctgtagcttcaccctttccacaggcgttgcactttgcaatgctgctgtcttcttgctatgaataatgtcaatccgacctgagctttgttgtagactatcttttatattctgtaatataaaaattttaaaacagtaaaaaaatgaattagctgtctatagaaagagaaaaatatatatatatatacaaatcccaaaggtagcaaatggtgttgcaattcttaattattgactttttaaagttaataaccatgaagtccagtgactttgacatgttcaaattcaataggtaaatcacagacctcatcctgagagagtggatcgctccctacatcttaaaactgccttcatttggcttctgtatcctgacctcttctgctttcctttgctggatccttctcatcctgatcttaatattagagtgctctgactcagtatttgcacttcttttcttctctgtccataatccatcccatttgttctcataattttaaatatcttatataagacaatgacacccaaatgtgtatctcaagcccggacatctcctccgaactccagtctaacaaatgctaatttctcaacacttggaggtctcacgagactttcaaacttaatatgacgcaaacaaaattctgaactgcatttcctaatccttctcatcccatagattccctcatttcagtaaatggcaattactgatttcaattgaattatagtaattcaattaacaattactcagattgacaactttggagccatccttaattttttcagtctccagtattcaaattattgggcaaatgttttggcttgactttcaggacatatgcagaatttgactgcttctcactacctttcttgctacagatctgatagaagctattattgtctctcatctgggttatagaactacctatctaaatggtcctcttgcttccgctctttcccccctactggataattctccacacaagagccgaaaagattcttttaaaacataattgggatcatatcactcctctgctcaaaatcttctggtggctcttcatcacagagttcaatcacagccaatttcaaaagcctacatgaaaaataattattcttgcaacactttatacaaataatcaggccaagtataataaagcaaatcagtcctatgatgatccatctttagtaaaaatgggagactggagagagaaaaaaattatgttttaagaactatggtacacctgttattagtctcgtcagctgtttttgagttttttcctgcaatatagactgatcctgcttattcctgtgaacctgccagtgatctctgactgcacctcagaagaaacaagaaggatgggtaatataaaaacctggatcagtattctaattctgggcatgtattggaatcagctagcagccccacatcactttggttccaacagctgcccagttcacggaaagccttctaatttagtttacttgggataattttacttattgtgttttactgttgtggaatatatttgctgttttactttttgtataggaatgcagaataagcttactcaatgttttcttagattgaaaacttactaatcttccagatatcaccatttatcagttatgaatggccctcaccaagctgatgcttgctgactgagctcctctctaccctgaatacaagagaccctaatagttaggcagaaatatcatcacccatattcagcctgaagaagttacagaagatgtattacccttctactacttaatcctaagggtaactctactacccttaggattaagggttcccttgtaaaagaaagaggggaaatatgtcagaggcgttcgaactagaacaactccatcttgaataggggctgggtaaaataaggctgagacctactgggctgcattcccaggaggttgggcattcttagtcacaggatgagataagaggccagaacaagatacgggtcacaaagaccttgctgataaagcaggttgctgtaaataagctagtcaaaacccaccaaaaccaagctggtgaaaaaagtgacctctggtccttctcactgctcattatacactaattataatgcattagcaggctaaaagacactcctagcagtgccatgacaggttacaaatgcatggcaatgtcaagaagttacccaatatggtctaaaatgggagaaaccctcagttctaggaattgctgactccttttcccagaaaactcatgaataatccaccccttgtttagcatataatcaagaaataactacaagtatcctgagtcaagcagcccatgccactgcactgcctacggagtggccattctttattcctttactttcttaataaacttgcttttactttttttaaaaaagcataatcttcactatgacctataaatctctacatgacttggttgtatactacctaccattccaagctcatctcttcccagtctcttcatagtccacaacacttcaccctcattaggtttattgcattacttgagtataacaactacattcttgcttcaagatttctgcccttgctgttctacctgccaaaaatagttttcctaacccacatttctatcagtggttcccttacttctttctcacgttaaaggggccttctctactactctattttaaatagcaccagcaatcactctttattcctggcattactcttcccttttctttatagtacttattactaacattaaaatatatatcaagtagccggtatataccactaatttgaaatctatgactacagggatgttgttatctgttgggcttccaaagctcaaacctgtgcttggcacatgatagatggcaaaagcttttttgttgaataaatgaatagatggtcccataaatttaatccataatgttttgtttatattctatttaacggaaaaatcacaaaccacaaatgggttatacgggaagaaagaaaaatctaaacatatttattctcaataaatttgctaaaaactacattctggctattcttcctagtacgaattttgttattttgatcatctaaattatacataaggtccactgagcaaaatttattgagttcttcccatgtgtaaggagcaatatagcagaaacaaaggtgggtgaaacacagtttagtttgcctttaagaagttttaagtaggttttattgtagtagtaagaaaggatatggtttgaagaattgaagaaaaaaatccaagtatagaagccttagctggatgagaagaaggaagaaatgagtgttccaagtggtaccaaacattttctagaagttagagaaaacatgtatcatatatttggtcataggctcaggaaagaattcacgaagaaggtgcaaattgcagtagacatatctgagtagtagaagtgggaagaacattagagctagtaggtaacacacacgcaaagctaggtaacaagcgcagtcatatttggctgccttttcagtaacatagaagcttaggggaagatggggcatgaaacagaggctgaggatgttcaataatgtgctttgaatctcaacagaaaattctgcctgtacttcagtagctaatggggaactatgatttttaaaaagttatcattatgtaagatttcaaatatatttgaaagtaggaaaataatacaaatagctcccataaccctataatccagtgccaactgttatgactccatggacaatccacccactcacctcttcaactagattattctgaaacaaactgatatattattttctccataaatacttcagcatttttctcttgctgaaatattctctcatgagaacttttttcggaaagtacatatataataccattaacacacctacagtcttaacaaaagttcattaattgaatcaagtatctagttgctattcacatttgagctgaagtgggaaggaagtttaggaaaacagctcagcagaattcagtgactgtgtgttgggtgaagaagaggaagaacttgaatgagtcttaggtatctggcctgggcatccacatgatttgtggtgtcattgggtaacaggatttcagacagatgaagaggttccatggttacatgcttgtgtatgtgtgcataagtgatcagttcaattttggacatggtcattctgaaaagcctttgaggcatcaaactgtagatgttccagaggcagttgaaatcagattttgagaagaggagtaagatggcagggattgctgagccatacatattttcacatttggatacatggactaggctttctgagcaaagagttgtagtaactgtcttaaagggtgactgaatggcaagcgtaccttggagtttagtgcattgctctggagagatttaaaaacttttatctccaagagccctttgattacatttcaacttatattccaaaaataatagacctagatcattggtttatagcccagagcaaagtctctgtcttcctgtatgtctgtctctctcactttctctcctcctgatacatcaggtgctctatataatctccaagatccacaattctgggatttctctcctgtactacaacccctgcactcacagataaacatcttgccctgagatgcttttgagtaattaatgatgtattctctcatccagagatcttatgtttcctgactagataaatataaattttaacaaatatcaacaaagggaatattcttttttttttttttttgagatggagtctagctctgtcacccaggctggagtgcagtggtctgatctaggctcactgcaagctccgcctcccgggtttacttacaccattctcttgcctcagcctcctcccgagtagctgggactataggcgcccaccaccacgcctggctaattttttgtatctttagtagagacggggtttcaccgtgttagccaggatggtctcgatctcctgacctcgtgatccacccgcctcagcctcccaaaacaaagggaatattcttgcctattttcagtcaaaattgggaagcattttaatcatttgtaagttggagactgtgttagatagggagtgactgctgctgatcgtacagctttccagatgacgggctctgaagaaaacttcacaatcagagagggaaacaggaaagaagttaacaataaaacttagaggattttctgccttattctaagatttcacgtttgtggtccacgaggacttgccttgagcaagaactaagctgaagaggcaggtgagactacagataatgtcagttgtaaaaggtaaaagtcaatgcttacaatgggaaccttataaaaagcaactgtgttctcgtgtcttatttatcagctcagcaacaggataagatacaatggttatgggtgatgtgagtgaatttcagagaaagaaggtgtttttaaaataaaatttcaaggcattctcttccagtctatgtacaccttgtgatggaaagctttcattatttcttttgtttcgcacctcaatttaactctgtggaaaaagtacttatctgacaggtcaggtattaccatacaaaagaaagaacaagccaacacagaaacaatctgagaatttacttatctggaggaatgcaggttaaaactgtcttttagcaatttcacatagagaattgatagtcattggaatgtgtgtgatgttgaataagactagggatggtcagattgctcaggaaaggtgtttagggtgaaaagagtgagaagaaaggtagcataaagatgaacctatgtggaaagcatgggcagaggaaggagatgagtatccctaaagaataatagtcatcagacccaggaagagaaccagaaggagggagggagttgtcaacaagtcagatgcagccaggaccaggagggaaaagtcagctcgggcaatttaggaggtcattggtgatcttatcgagagcaacaacagcatgttggaagtggaaaacataaatgtaggcagaccagactgtcttttgctgtcatcatctttcactataaaatagaaaatagctttgtacgacattgcagtatgctgtatttgacatcagaggcttgcttattgaagaaaagtttcatattgataaaaacaaaactcataataaaacagaaactgttggatactatgctcactgcctgggtgatggggtcattcatatcccaaatctcagcatcaaacaatatatccatgtaacaaacctgcacatgtattcctgaatctaaaatacacttgaaattataataaaagagatacaatggatgtaatacctgttattaatgccctaaaagccattgaactcaagcgtatctctagtattatttctttacttttatttacctggtagaattttactaccatcttctgatggctccaagcctggagtcttgggtggaatgtttagggctactccgctagcctgattaggtcaggtaccagaaacgtgcaccaacatatcttcttggctgcttctgttaacttgcctgacctgggcagcctgatttcacaagtacttgattcaactctgaattcttttaagtcactgtctccatcattcttgcttggctgccagtccaatggcaaagatacataactctgccaagtcctccacctgataccaagactccagctgaatgaaaggctgattacttaaattcacattgggcaaccaatcacatttgttagtacatagcaggcccaaaccctttaaatgcatagctgtaagcacccatggagaaaaacattcaagggaagagataaaggatcttccccatcagcatataaaagttatccagttatggctttgatatggtatgcgtgtgtttgtgcgtatgtgtgtgtatgtatactctctgaggatttgagcttgcaaagcttcctgattttaatctgagtctctggggagctaccaattctttggaatgctgtagcattgctcagcatcaagttatgaacggttttagcaatgctgtacagcatgttactaacgcgggaaaactttctatcttaaaggagaaaagcaaaaagcaaaaactggggcaggggatgtcacactccctggatatctagataatagctccttggtgcattctcagagaatgctgtcaaaattggctggagtccaggaaatacatcctttttaaagtccctgcacatattcgtgtcctcaaggcactgcacacagaaaaatggtatgtgcaccaaagaaaatgctgtagcactttccatagtttaaagtcagagatgagatctctgatagtattttactattttagtttgtctagaaataagtgatctttatagtttctgaccctctaaaaaggaagccatagtcccttgtagttgctatggcgatataaacatccctagaatcactatagaatatagcatttctatttctctccctgaatagttccttatcttatctgaaaatatgatgtcaaaatgataaagtaccaactttttagtcaaatcccttcttaattttgacatgcccctatgaattgaccacttcactattccgctgaaattctgtaagatgtttatttttggccactctttctgcaaaaggaaattctaaatatacatacaaatggaattttaatttctgaaaggcatctgtacacgaatttatacaactcgagtccttaatattttaaaataggatatttgcatctctgattcacagtctccaataagttaaagaagaccctgattatgcactgtgaatagagaaaaattagatagcacagtaacttttacaaccggcagatgaaatccagatacctaaagtaaggaaaagcagaaatctataagccatgtggcttcaattcatttatctgtttgaaaagcttattgtttaaataagtgtttattgataatacagacataatatcagcctcaaatgtgagatatgaaaataaagactttaaaatgtgagtctctcccttaagaagataattggtttttaaaggagacacatacagaaataatttgaacataaaaatgctttgtttattcaagtgttgtggagtatgtgtctttaacaggataaaaggagaagccagagaatacagaaaatttatctaggaaacaaacaagggacctatttgccaactaatcagtttaagataaaggtatgaagcaacccttaactatgctccattctttatcataagggatagacttctactgtttagtttttcttccatttaatgtaaagtgacaactactcccttgctgtcaaagattttcattgcagagcctgcctttaccatctaaatggtaaacttatgtgtataaatgtcaaagtagatattgcagaacctgaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcacttataattcacatttttaaccatatttatttcctgaaggaaattcctattcactcacttagtaatagcttccccatttcatctttccctccttggcaggattcagtacagttaggcacagttttcatcatacagacctagccacactagttttaactagtaatactatcttctaggtttctctctctgtgtctgacagctacatcgctgtattcattcattaactcaagaaatatttgttgaaaaaacctaccatgagacagtcatattttatttatttatttatttatttatttatttatttattatttatttatttattttggagacagagtctcactctgtcacccaggctggaatgcagtggcgcaatctctgttcactgcaacctccacctcccaggttcaagcaattctcctgcctcagcctcccgagtagctgggattacaggcgcccgccaccatgcccggctaattttttgtatttttagtagagatcgggttccattacgttggccaggctggtattgaactcctgaccctgtggtcacccgccttggcctcccaaagtgctgggattacaggcgtgagccaccgcgcccagcctgagacagtcatatattatatcttgggtatatactagtgatccagaaagcaaaagccccgctctctggaatctcaccttctacaggagaataaagtaaacaaatagagaaatgactaaactatatactcagttagatagtggttaagtgctgaggagcaaaactaaagcagggaaggaagaaatgaaggataaagtgggggtcagaattttaggtaagaggggtcggggaagaccttaccaggaaggcagtttttaagtaaagatctgaaggaaatgcagaaattaaccattgaaagaaaaatcatgagaataatattccagacaggtaaagcaagtataagggccctgacactggaatgtgcctggaggagtggccaaggaacatggaggaagtgattatggctggagtgtatgagctagcgactaccagagaaatatcagagaatggggtgggtaacccatgaaggtacttatgaacataaggacttccctgtttactttgagggggatggggagcattgggggttttgaacagaagcagaaagggggatataatctgactttccatttaaataggtatctctggctagtatattgacagtagagtctacaggggagaaggcaatgagggggaaacttgttaatagacaactgcaatcatccatgctggagatgatggtgctttggatcagagtggaggcagggttgaattccggatacattgtaaaggcagaatccttaggatttggtggccaattacatgtgtgttggtagagaaaggccttaaggataacatgaagaattttggcacagacaagtggaataatggagttgccattaactatagtgtagaaaactgcaggaggataaggttagggtgtaagattttaacatgctaaatttaagatgtttattatacttctaagtgaatatataaaaggcatatatatatatgtcatgattcaggagaggaatcttgactagagatataaatttgagagtcactaggggtaatttttaatctcttccaaacttgctcagaaaatactgatgttttgctatattccctttccagacctcttttcttccaaacccaaccctgtagacaatcttagccatttctatcacttaaatcaaactttgacacaaaggaattttatttaggggaggtgggaaaggggataagaaaaatgtcaagttgggagcatagattcactgctgctggggcccaacagagaaggcacccagcaggaggagggagttagccctttgatggttgattctgcttaaggctacatcaaggtgttttggggataacagaaatcgaagaagctagaagaaagtacagggaaaaaattcaagtctacaggttggtagacagtcagagactcttggttctgttgccatggtgggattatatacaccttccagaaaacctttccttaaccaatcagagtatttatttaactagatagaaatatgtatcgggaaatccagtccacattttgcactaacacaggaaaatgggtgatctaggatgttgggcatctcctgagtgaactttaataatgagagtcctggtacagctactgaatcaagggtatggtttataaatcggtccagctatgctgaacacaaatatctccttacttattgttttatctctttatttttccttgtgtccaatttatcctgccattttaaggattatccctgaccaaaatccatccatgatgacatatagctttttggacactttcaagcccatcttttagcccatctttttttccaggaaaaaaaagaaaaaactggattcacagtttttatccaacttgatttcctagtgctttgccagcagagacacttgaaaggataatcaaagtgaataacaaagtgaaggattaatctctttgttattcttcagacacatccttctgatacaattttttttttttttacccttactgactttgtatctttaactttgaaaacattttctgcatcaagaaactgtatagcgtagtgcttaagagcagaaactctggagcttgaacatccagagtgggacttcaactatgatatttaaaaatgatctcacctgagcaagtcacttaactgctcaggacctccgtttctccatctgagtatgggtataataatacagccttccttgtagggctgttatgatgaccatacaagttactctaagtgtttagaatgtgtcctggcacaaaaataataactgtcagctattacattcaagattagtccagattccagttatattcacacctcaagctaaggattcctcctctataaaattcctcctagtttctgctttttgtgctgctttcttcttttcatgatttcagttacactcatgtcttatatatttttgcttggatgatgtccttaatgtctttattactctctaacttgtttgtataactataatatgtatattcaataatgttatcaactaccagagtacaaggattattccttaatatttctttcttatcttttagaatgttaagcatagcacttgtagcattaataaatatctgttgacttgaagtaaaaagttgagttgaacttgcttatgaaaatccaatttgaattcaatcattgaacctctaagatttgttactctgttcaaccattgtagatagatattcaggtatggtcagacgtgagctattcaggtaattccttgtttattctactttacttttacaagacattagctgttgaacagtggaatagaagtccacatgcatttcctggctgagtttccttatggtttcctcacagcacattagatatctaagaaaaaagtcctttattcagaattacacctgcccatttctccagatgccacagagcatcaacaagaacaaaaagaacaacaaaaaaaaccctgcactttactgatccaagtgtttctcagataaaatgattctagtccatcagcactaagtaaattgaaaacaattttaccagtccttttatgatacgtacattttgtgttaagttgtacacatcgcctaaatcattttacagaaaatccaaatagaaaaattgactcacatgcatggcaaagggggttttatagaagtaagtacttttctcttagttcaaaatatatggcattctatgatcccaaatttcttagagtcaggatacgctttagtgttgtgtgactcagcagaggagggccaggtaggttttatggaggaaaaattccaaagcaatacaacaatccaagaaaacctcaaaaactgatgatcaccaatgaatggaatatgcttttttaaaattcatgttatactttttaattctatttacatatgcaatcatgagcatcttattattttgataaatgaaaatttagtataaatgattaagcaacttcataggtagctaccatacatgataaaatataatcaaacctgcaaaaattaatattgatgacagtaaactattttggtaaaacagaaaacatatttggtaatattatgcccgttttatatataactaatacttctgatgttggggaaatgtgctttccatcatattgttttacacaggggacagaaaagcaaaatcgctctttcatacaattgttctgtacccaaatgcatacatctaaaaaaaaaaaaaaaagaaagaaaagaaataaacaaaaggcatgatatgggagcaggaagctaacactctactcaatgtttacctttttggaagctccatagatttccttactgataacactatttaatttttgcctgtggtttggcaaattaaatttgggaattggtgtctgttaatcatacgtgatttacaacagaaagttcttgttttttttccatcaggatgtttaatgatatatattaatattcagaaataagcagacttgggtacaagtcattgtattaaactataagatattgccaatatttaaaccttttgaaagacttgacaattcataaggttcaatggaatagcattataattttaatatgttcatggttacaaatttaaccaggagaaaataaatacaaactaacttttttaaatggcaaaggaaagacaacaaaaaataaacaacaaaagcaaatttcaagactccaaagcaaaaaagagaaaaaaacactactgattaaatcattctttgcttagagtttcaatatttttcaataatttttgtcatggttctgaactcacaattagaacaatgggttttaagttactgaactagaaatggaaaaaataaatcaacacatttcataaagaaactaaagcccaaaataaaacaacaattaaaaccaagctagaaaacagcatcctcttcttggtaaaagttatggtacacagaatcttggaataatttagagttgcatttctgcacctcaagataaatatacaataaagtgagttatttgttttataccttaaataaatagaagaataaaaaaattactcctgaataagtaacaactagcctcggaaatacacatggcccccgtcttataatgtttctacttagtgatttttcaactttagggtggtgagaaagtgatatacattcattcgaaaccatacttcagtatagtattcactaaattgaatgagatattcaacactttactataaaataggtcttgtgttctatgactttgcgcaactgtaggttaacataggtgttcagagcatgtttaaggtaagctaggctaaaccatgatatttggtgggttaagtgtattgaatgcatttccgcatacaaaattctcaacttacaatgggtttatctggatataaccccatcacaagtcaaggaacattctgtacaatagaagaatatgatcaaaagtttgtaagatcctctaaggaagattttgtcaaaagcaaacgtggcttagcttgtatgtattctcttattttaaagtttttttagctttagaatatttgccacatctggaaataactttacgtatattttatgtggttaacattttatttacagttttttaagatataaatatgcaattttataatgtttaacacattcttaaaggtaatttgtttttaggatactttacgtggaaatttataactttcttagaatttgggatgtttgatgaagcaatatgcattttacaaatcttgaaatttatataattatacattttaacaggaattttcctacacagtcgtacatgatttcactgtatcttcacaagagtacagttgagtaggcaggggcagttattatcactgatttaatttcaacgttaaaaaacaggcctaaatatcttatgttacttgcccaagggtacaactatcaacaatcaggttaaatctttctaagcttttcaggttccaatacagtactttgctaaactctctactctactgcttatcataaccacataatgaaagctcactgatgtggaaaaatgttagtaatgttttaattatatgtgggttccctgtcacacattttcataaatgattgttttagattcagtatatacaaacctagaacaatttcttcatgcttatatgcatatagatttgtagaatgcacatgtctagatgatttaactcagtgagttaggatacaatataaaaagaagtaaatttggttttctcttttagtaccagcgcttactaacactgccctgtcttcttctatctcagagtccacacctacatgtatcagaccatcactcactaattcaacagatgtacattcagtacctttaagtgctaggtgctgttctaggagttctagatacagtggtggaggaaaaaaacaacaaacaagatactaatttttcttcctggtggctgtgtgtatgtatcaccttcttgaaaaatgtagcactgcagttacatgggttatacatatacttaaatgcatgtatagtgtttatagacttataaaactctaggcactattgtcgtcatattttgggaaggtgaaaataatagctttaagcagttttaggtatcagaaatgccttgagacactttgtaacttggttaacagaggagcacataactttcatttctaagaaaaaaggattagaaaaacccattagtaactgttgtgacagcggccgttggggagtagatctatcttaaaatggaaaaagagaaataagagaaccaaagactcaaactccagttcattttcactctctggaatttgtctttatctgacagataaaggcaacaccctatataaatctaattcttacactcttcacatcccatccagctaccaggcactacattaatgacatatcgaattgggaactgtgttcaatcaaaaggcattaaagtacttattaactaggttttacggagcttccaaaaaaagttaaaaagttatttttggtggctctatggtaaggtgaccttttaattttttcttcatggtttattgtccccatgtgagaaaacactttctaaacacagctacgtatttggaccaaaatattcttcataggatgatgcattgtctttgcataaataacgaatcagtaattatatatcacacataaaaaacgacattataactggtcgaagcacagcttcaaccgtttgtgaataaaaggaaaacctccccacaacttaactgcaacttcaaaatttctaccagcctcatgatttgtaagttttaatatggaagtttctgctttctacactttacacgatggggattatgaaaacagtgctgctgggagaatggaaggagtaggagtgcgttcttaaagtacattttagcagagttgggagtaaattgcagcataatagtcaaggtaggacaactgctaggcttgataaaataatggttggggataaagaatggataatttcctacaagagagatttgtataaaatataaaagaaaactgtaccgaagcacatataaatatgagctgggcatgactgaaaggcagtaaatatctataatctcttctctatagtacaaatcttttcatataatacaaatgaaaaataatgtactatggaaataatttaagcatgatttaaactacagttaatgattaatatttgaaaatacacacatttatatatagcaaatcaatcaaataaatcccaagtcatataagctgttgaagaaacaaattatatttataaccaaataaatgtgttgaaaaactcaatttttctaagagaaaccactgatcacattattgcaaatgtttatgtatagttcaaaagatcagtttctacaaagtcacaatgtattaataaaaatcatcttttccacgcattaaactgttagaactattaaactattagaaaattcaactcgaattcaaaaagcatttgcaaacaaattttgctttgaaattttatatgatccatgattatttagagtaattgcaatgtcctcttattccaatattattaaatacccctgtattacaatatgcatataaacaatgtaatatgcccctgtattacaatacgcatataaacaatcgttcttttattttccttcagatattttgtttggatttctacatatggtgcctcttgctattatctaattctcctaataccagaatagaaaagcagtcactttgctcatggcataattttgccttcatttaactaattgggattattaaatttgtgcttaagagctgtgaaacagattccagaggagaaagatcttaaccagtgtattaaaaatctctgttgccagtacttttgtccctacttcaaggcaagactgaagaatcgaagactaaaatatgagaagaaatcatacatctctcaagggatcttctgctaggttttacgagaccaaagttctaactcagccccaagtcggccgagaatgggttttcatagacacatgcttaagtttctgtatgaccagagaaatatatctgctatctctaatttcaaaatatttccagaatctgacattctctcactaccgaccaagtccaagccaccagcatctctttttcaactcttgttgattctattattggtcccctacagttctactctcaacccagaagccagtgtgatccttttaaaacatgattgagatcatgccactcaactgctcagaaacttacaattgctctcatctcatttagaatcttctttacaatggccccaaaggccctccacaatctggacactcacaactcccatatcctcatctctttctacccttccactggcttgttttgcttcagccactttggccttcttgttggtgcttgattaagataagctcagtcccacatttgggcctctactctatttcctctacacagactccatggctgactcccttaccttcttccaatctttgctcaaaggtcatttctaccctatttgaaatggcaattccgccactttcaattatacctacgtctacccctgtagtggtcctatatccccttaacagattctggtttttttttttttcccaaaatacgtatcacctagtaatacgcaatatttacttatcatttttctttgtttgcttgcttctattctgtctcccaatgttataataaaagctgaatgagggcaaagattcgttagtctttttcactgttttataagcacttagaatagtgtgtggtacatactaagagcttaataactatttttggaatatacgaatccacattccttaggtttacttgtcctaacaattttttgtttctcaagagcaatgcaaaaaacctgaactcaagaggacttgaacgacctggcttcacactatctttggcttataagctcactaccagctttcccttgtggtctcgaacttgaacaagggttgtctctatttcttgatcctatttaaaatctacattaggaccaccatgtctcctacccgtgagctttcttcatatggccacgtttttcatcaccctcttggttacccaaagtatagcacattttattcattccaaacaaggcatctgtactataattggttttgatgagacaactgaaatgatgtgtgcctgatattttttctttccttccatttatttcctccttgtttctctccttattttatttcttttcttcaattctccctccctccttccctcactctctttcttccttacttcctcccttccttcctcctcctttcagtgatttgaaactccagtgcaatgtggaatattgaagggatgtgggcagatatccttgtcttgttcatgttcttcaggtgaagacattctgctctaccataaagaataatattagctgtaaattgattctcattattgcaaaaggtaaagcatagttgtcattcttattataagctatgttcttatttttgtcctaaaaattcacatttattgataccaaggcctaattgaacagctaaggattccctgaatgagggagcagcagaatcacttgaagaattccactccaaaggcatgaactatttctaagaatttctctacgtaaatgctaactacacagtaaatatgtcattatttatttcaaaaatgtcctagatagagttcccctataagcagattcgaagacaagggatgtctttgggaatgatccaaggaggtgctagtaaagtgtgtgtaaggtaggacagggagcaagtgaaatgtatcctatgaggcaggtttttactgtgtgcgatggggtcttaatcctggaacagaattttgggtcagagcataaatcatgcttcagagttaccctaactgaagaatgagtgagtagtggtatttatccaccaaaagttatttgttattggttgaggtttgctggggaacacgggggatgcagaactttaactacctgacactcatgagctttgattactagagagagccctaaggcaaacagtcagagacacttggatctggcagctaccagtcagagtacaaggcatgctgagtcaggaaatgatatgggtgacatcccaagagtgtttcatcctccaataaaactgatgctttcagtaaaattaggcatatggacacatgatgataaatcctttcagttaagtcttttaagtggatcatttctgcttttaggataagctttcaaatatttaactctctccagagaaaaccttttggtaatttaaaacttacgatgctaagaaattctgtgttcatgctttcatatgagatactttaaggcaggatttgacggtttaacacagtaattatattttggaaaattttatcatgaaaatgattttttcttaaaaatgaaatgcaagttaatattgctctaaacttccaaaaaattgcaattcttctaaaattatgtactcttgtctgttatgagtattattaactttgtacatataagcaatcacaatcaattaactgttaatattggctctgaagtaagaaagaaaatattacttatgtgtatgtttctcattcttctctagctctgccttagctagtgtttttgctattaaatgcagatttccacatatgtatatatatatacgtatatatatatgtttgtgtttatctgcatagtctctgtcaacatgattaggtagctttccaattcaatacatctattgaaaccatacgtgctattttagttgtattttgtttagaaagtaattcttttaacatattacatattatttgtgttgtactgcactttcaaaaaagatgtatgttaaagcacagcaatacttactatagttctgtaatttgattcatgcatatctgtcaggaataaaatcaaccacaatttcaaaccttcccaaccagcagctgtacaatttatgcactgcttttccatttttactactggataatgacaatgatgaatgcctttaacaggaaatacatattcactgaaaagactgagctcaaaactatcccccttcaaaaaagtcaatgaaggtaggaagcccattcacctgctggagatttgttgggagacagaaggaatcatgcccacaactgtatcttatggggattcaaccatttagctaaattaaatctacaataataccatattataaaccgcagtaatcaatactattacgattgacatcagctataataatattaaatagatcaggatgaacaaatgattcactgtgagtgtagccaagggtctaacattctgagtatgccaggctaagaggtatggagacagagttattcaatgggcaacttaataagatcagggtcactactctcctgaaccaaatgtccatgaacctgggaaggaatggatattagctcattggcaataatttacttattgaatgacaatgatgcacttacaaactatgctgccatgagaacttagttaatagaaataatgacaggaattctggcatgtcagctttattttattaactgattaggtttcttttcttcattgtaccaataagtgatttgacttttacttcaaacagaataagaaacagtgccacactgacatggatggaatagttccagagatctgtgaagctcttattttactgtgtaattttatagcttatttgatataatgttaagatattaaagtcaagtcactgaagatactgcaacaccgatttccaaaacaaacaaatagctttatccatttgtatattcatacaggcaaatgtgtgatatagaatgagcttccaggaaaccatttgagtataaaatactttagctaatatgtgctgctgatagcaaacccatcttttgcctataatcacatactgtttgcatttgaaaataccaagctctgggtatactataatatttcattttgagtgtaaaatgtacgatcatgaaaattatctggagacacattattatgtgcattttcttgatcctacattcatttatcttcagacactgccttctgaaattcatagcctatttcatcatcattatttgccttacttgagaatttagtaacttgctgttggtggtttgaaaacagctggattttgttggtagcctttaactggcagttataaagaaaatattttattgatttctattcaattttattccatatgttatagcacaggtattgacattaatttgaaattgaatatgtatacataaaaaatataaaacaaaaacaatatacattacatataaatgaaaaatctaatttccctttttggaaaatgaaacagaagtcatccattaactaggaataaactgttcttccatcaaagtttatttactggtggttcctttctgtccctactgcatgtaaaaatgatcatttttgtgcatttcttcattttaggatgtctctcaaagctaaatattgtaaaatacattttctaacttatgtctttctaccctagatttctgaagccaaccacactatcaagtatttttaagaattccatgtgaaagtcaaaatgccatcatgatgcatacaatttaagtcaattgttctggcactatgaatgatcagtatgatcaccttgtaaaatacgaatgaaagtgctttggttttaccttcagagactcctcttgcttaaagagatcttcaaagtccttagcacagaggtcaggagcattgagaagttgttccacttctaatagggcttgtgagacatgagtgatttcagtcaaataagtagaaggcacataagaaatttccaaaggcatgtcttcagtcatcaccatcatcgtttcttcacggacagtgtgctggtatagatatacaaaagaacaattttttttagcttcctaacagtgaaacctcctccattaagtttatataggtctcattctacagctgacaattgaatctacaaactgggctgaaaatggattcaaaacctcacgatggtaagtctagtaaaacggtgatttattaattatatacctactttttccagaaagtgttaaaagcatttcataataagtgacacacacatattagcaccataaatataagacgaaagaccatgaggtcataaggagagtagttttatcctaagaaaaagacgatttttgcaaccggcatttaaatttctaattctaatttgcaactggcatttaaaattctaattttcctggaaatctagatatgggattgggtgagggggactcatatctgttttattcctaacacaggcaactttcctgtatctataggaaagttcactgagatacaacagatacgaagtagttaggctggtatgtaactttgtattaagccctcttctcctccaaattctagacattagctcctgtttttgttgctagtctcttgctaagttaagctgctaatgaagctgctatatgagcagaactgactgcggaatttatattttaaaaagaactccagaatgtcctgatatataagggagcactagcctcttctcttgcacctacacttttctgactgggatccaagtgctagacatgatgagaatttccagctccagagtccttttggagtttcccagtaatacatctttccctattctttataagagcaaaaaataaatactacttggcaggcaaattcagaaagatggatgacctgtgctctcttctgtctacactataggcagcaaaattcttgtaattgaaattattctcccaataactttgtctagaattgatcaactgccacctgcctgttgatgaggtcacctgagggtttcagtggtagggtctctggggaagtacaaacgataagcatgctaacgtagccatttattactgcacagccttttatgacaacaccatacttatttttgcagtaatgtaatacattggactttggggatactagactgaaccccacacaaagaggagtaaaatttacaagctggtcactttatgttttgtttttaatttctctgacctaggattttcatactcaattcttacatgatataaaaaatgaagtaattctaatttagatatctcatctacttgtgatatagcaaattcacagaattgcacaaattagctattaaataattataccttttacaacatttgttttattgtgtatatctgggccaaatccatggcacacattccttcatgttcaatggaataatgtatatatatttctcatttacatttaaaaggatattagaaacttgagccagagtttgataaataaaattcagaatttaacagatttcttaagaaattcttaatttcactatttcatcataagcattttacacatttaaaagaaaaataactcagcaggctatttgaatgtgaaattttcactgacacattaaacagtagaatcaatagcacaagtaacacaagcttgtgttttgcacgcattacattggttggtgaccattatgttgttcttaataaaatttacaagttaataagctcgtctttcttattcacgttagttgctataacccctgcagtaaagatagcttcacatcatctaaagcaagcgtatttcttataatacttatttaatggtgcaattaaatctgcctttaatgatacattttacacctgtaagtttttggaaaacaaaggtttttgttatcaggaacagagtaagtagaagacaagttgtagtttttcatttatttattaatttgttttgttgtttaatcaagggagttgtttcagaattggacatatcttgaaaatatttagaaaaaaatctgggtggccttaacaaaagcagtgggaattcagaaaagttttgatgcatgtcctcatcactttttcttaaaagaaaaataattctaagatgtttttatctattttctgattcttctttgatatgtagttttctcagtcttcattactttcatttgagatgctctcagctatcttaaattcatattggtgcttaataaatatagtaattgtggattatagccagcaagaaacttagctgtatggtcaaatataatgaagaaaaagacactcaaaatatactcacttttgtctgctaacttgtatttaacttccttaaatgaaatttcaaacccaaattttgactattttggtatttgcagaaaggaacgttaaataaaaatgagatttgccaatgaatccaggagctggtcttttgaaaagattaacaaaatagatagaccactagccagactaataaagaagaaaagagaaaagaatcaaagaggcacaataaaaaatgataaaggggatatcaccaccgatcccacagaaatacaaactaccatcagagaatactatcaacacctctacgcaaataaactagaaaatctagaaaaaatggataaattcctggacacatacaccctcccaagactaaaccaggaagaagttgaatccctgaatagaccaataacaagttctgaaattgaggcagtaatagcctacgaaccaaaaaaaaaaaaaaaaaaaaaagcccaggaccagacggattcacagctgaattctaccagagatacaaagaggagctggtaccattccctctaaaactattccaagcaatacaaaagaaaataaattcttccctaactctttttatgaggccagcagcatcctgataccaaaacctggcaaagacacaacaaaaaagaaaatcctcaataaaatactggcaaaccaaatccagtagcacattaaaaagcatatccatcacaatcaagtaggcttcatccctgggatgcaaagctggttcaacatacgcaaatcaataaatgtaacccatcacataaacagaaccaatgaccaaaaaaaccacatgattatctcaatagatgcagaaaaggtcttggataaattcaacaccctttcatgttaaaaacactcaataaactagttattgatgggacaaatctcaaaatattaagagctatttatgacaaacccacagccagtatcatactgaatgggcaaaagctagaagcattccctttgaaaactggcacaagacaaggatgccctctctcaccactcctattcaacatagtattggaagtcctggccagggcaatcaggcaagagaaagaaagaaagatattcaaataggaagagaggaagtcaaattatctctgtttgcagatgacatgattgtatatttagaaaaccccatcgtctcagcccaaaaactctttaagctgataagcaacttcagcaaagtctcaggatacaaaatcaacgtgcaaaaatcacaagcattcctataaaccaataacagacagagagccaaataatgagagaactcccattaaaaattgctacaaagagaataaaatacctaggaatacaacttgcaagggatgtgaagggcctcttcaaggagaactacaaaccactgctcaaggaaataagagaggacccaaacaaatggaaaaacattccatgcttatggaaaggaagaatcaataacatgaaaatggccatagcgcccaaagtaatttatagattcaatgctactcccatcaagctaccattgactttcttcacagaattagaacaaactactttacatttcatatggaaccaaaaaagggcccatatagccaagaaaatcctaagcaagaataacaaagctggaggcatcacgctacctgacttcaaactatactataatgctacagtaaccaaaacagattatactgatagcaaaacagatatatagaccaacggaacagaacagaggcctcagaaatatcaccacacatctacaaccatctgatctttgacaaacctgacaaaaacaagcaatgtggaaaagattccctatttaataaatggtgtcgggaaaactggctggccatatgcagaaaacggaaactagacccctttcttacaccttatacaaaaattaactcatgatggattaaagacttaaacctaagacctgaaaccataaaaactctagaagaaaacctaggcaataccattcaggatacaggcatgggcaaagacttcatgactaaaacaccaaaagcaacagcaacaaaagccaaaattgacaaatgggatctaattaaactgaagagcacagcaaaagaccctatcatgagagtcaacaggcaacctacagaatgagagaaaacttttgcaatctatccatctgacaaagggctattatccagaatctataaggaacttaaacaaatttacaagaaaaaaaagaccccatcagaaagtgggcaaaggatatgaacagacacttcgcaaaagaagacatttacgcggccaacaaacataagaaaaaaacctcatcatcactggtcattagagaaatgcaagtcaaaaccacaacgagatagcatctcacaccagttagaatggcgatcattaaaaagtcaggaaacaactgatgctggagaagatgtggagaaataggaactcttttacactgttggtgggagtgtaaattagttccaccattgtggaagacagtgtgcagattcctcaaggatctagaaccagaaataccatttgacccagcaatcccattactggatatatacccaaaggattataaatcatcctactataaagacacatgcacacgtatgtttattgcagcactgttcacaatagcaaagaattgcaaccaacccaaatgcccaccagtgatagactggataaagaaaattgacacatatacaccatgggacactatgcagccataaaaaagaatgagttcgtgtcctttgcaggaacatggatgaaactagaaaccgtcattctcagcaaactaacacaggaacagaaaaccaaacactgcatgttctcactgataatgggagttgaacaatgaaaacatatggccgcaggggcctgttggcgggtggggggcaaggggagggatagcattaggagaaatacctaatgtagatgacaggttgatgggtgcagcaaaccaccacggaacatgtatacctatgcaacaaacctgcacgttctgtacatgtatcccagaacttaagtataattaaaaaaaaaaagaaaaaatcattcagtgacactggataaaataaaaattagattcacttagaaaataataattcgtgctctcagaccagaattctgtgtctcagcaaataagatccagtgttaatcatagtcctaaaccagggcttaaagaatgtaggcagcacaccataccctggcttctcatctgttaagcttctctccacctgaccccatgtgtctaccatagattattatataccgatttaacaaatattcttcagaacattaaactaaaaaccattttcacctatctttcaaagaaaatctcttttagaagagtgttatgtggcatctatttaaattgccaatttttctggtaatcatccttttactctctgtacaagagttcaatttttaagaaaattttagatacctaagtgacaaataattgtaattctgtatctggttctagaaatcattttttacaaacttttaaataatgaagaagctcttattaacctgatcgaaatactcttaaaagaaatattagccattgaactgcaggttgagaatgctctaataatatgcatattgtgattattttcaagattgtcacaaataagccatagagcaaccagtgtcaatacatggaaataatccctacatgctcagccatggcatgaacacattttctagaacacttagaaatattaaaattcttatggttgaacataatcaataaaaaggtatagtttattactttagaaaaatctgaatgagaaaaatcatttctatcctcaactactgataattaagtaatctttcaaaaatttttctttccattataaagataaattagaatacctgtaatttctaagatgcttctcattacaattacctatgggcaacagttcagctatacgttataaagtctaaaaggttaatgttatactttaaatatatttaatgaagacggatctattgaaagatttactatcttgatacgtagtgtccagtcatcacagataacagacactaagtggtacagatcagctgactagagaaaactaagggttgatcctgtgaactttcttgagaaatagaaatattccaaaataactttttgacaccactgggaaactgtgaactcattttctagaaaattccgtgttattaagtttgaatattctcatttattatagcaatctgatatatacaataatgtttaatatatagacttttttgtaattttcatatacaagaaactaccagaaattgaatcaaaagagaaccagacatttggagatctagtttgctatctattccttaaaagtatagcattcctattgacacagtcatgcgaatctataatgagaaaactacatccattgaatgactttcagtttggtttaataaaaatttcagacagttatttaaaaatcagtgtaattagaaatatcatgttcattttctcttctttatgcaaaatccaggtactcattcagattaatccttttcatttgaatttcattaactctgccttgaataattttatccttctgagttctgatgtgtacaaatcccgtctaaccttttgaaaatcaacttgcttttgttaatgttctttaccaccttatatcattatagatactcatgcatcattagcaaggaaatgctataatctgattaattcattttatttctttgtgtttattttcatttttaaccatatataccccaaagaatatactagcctcattttctagaaacaaaaagatatgtgaaagaaaccataaaatgcctatttttatttaaaaatgaaaagttcgatcaatgcttaatgactattatagaacacaattatgatttgtatgatctaaacttaaagtcaaaacagttttaagattctgagctgtgtaaataggcacaggtatcactcacaaagttttgaatacattttcattcatctgaaacttaagttatcacattcttttcattacataaaatttgtttcttgaagggccataactgcaaaggataaaagcaatcctgttttgaaacaaatggtgcattatgtctaggtttttaaacaaaatgttttcctccatgatttaaaagacttctttctcctttaaatgcattgaggttactggcccatttatgagttatgaggtcaaagaaactcaagaagaaaaatgtgctatatgacatatgattatgacatatgccacaaaataactatatatctcatataaatatggcacatgaaaaatatatcaatgcatcaaaagtgtaacaaaaatagactattatcttgaccaaaaacagtaaaatagtgatggagcctttttttttttaactgcgttggtgttaatgaagatgaaaataagcaaatcctcaaagtaagatttattaatgatttagtgtgagctataatatgaaaatctatgagccataatatgaaagtatgtcagtttgtatctgattatctttcctcaaagggacattcttaaatattatggattatttaaaagtaataacacaatgatatgtaaatccaaaataggactgcaggctttaagtaggttctgatgggtcataaatgaaaaggcaatgggaaagacttaagtcttagacaagtagctctgtctcttagccccacaagtcttcagagaaagacaagtttccttctaggaatcattacagtaataaacaaagttgagagattttttatttatttctcctggacaattataataggcattgtaagcataaaaatgcaaatcacaaacaaattaggcaaaaatattgtattggtccagggtgattaaaaaaccccaaacaataaagcataaaaacaaaacaacatgatgcaggtgagacgggtatggttttaatctgcgttgtcactgttttggatacatataatggcatgacaataacagcattctgacagtacttcgttttgtctgttttagtcaagtcactgggtagaaagatgttgaataatcaatctaatgagtctaagcatattggttatgaccgtgcatagaaaaaatagcaatgagagagtgtttgctcttatgtgatttcccccttcctattgcatcatctaaaaaattgcttatgtgaagctatgtaaccaaaaaaagggcctgtccatctcagaataattattcagaatcaatgaacaatttaccccctttgtttaaaaagaataaaactcactaacatacacaaaatagtcaaggtaaaatatgaaagaaaatcatcctttatgcccatattatttattttctaaagttagaattaatttttaaagcagggcaggctgtcagcgaaaaagatatgcagatgatgctggatttgccagtctttaaatacaccctgcttctagaaggccaggtataaatagtgtcctatgtaaaaggtctggacagacctgctcattgacctgcctcatgtggattctgactttctacaccatgaaatttacctaattcctcagggccaagctcaattactatcaaattaagctgataaactgaatctggaaaatgtgttaatggcttatagtggtttaaagtctttcgtttcaaaggacaacatttgcatttttatacagattttcaaagaattaacataaattagtaacttgataaaattttagtcactaagtatggcctgtgagagaagagaaagaaaagggctttggttgccaccaagataagtatcaacacataagcagcaatatataagcaccaacaatcatggcctgctttgtaaaaccatctccaaaaaataacctataaattaatagataaggttatacaccctagccaacttataaggcagcaaaaaataaatgcagcaaagactcatgcctagtacctagcatacagtatgttatcaaaaatatttgttggataaattaatgaaaaaacaagtatcaacttaacaggataattataagatagatatgtggttacaattgctgggatttacatttataatttatatttaggaatattcagaattcaaacaggaatattttcttcattttataatgcaatctttattgtcatagatttaaaaggtatatctgatttcactatgtcgcatttcttcaattcatagcacattagctacatgctattgtacatgcgtgcttaggtccttaaattgtcttttagttactaatctgactcattatacttgaatacaaacataagcaattatttgaggtaatgacatatagacgatattaagatatactgattttagcttcttcatgggtatcataatgtctattagcaaattgaagggtatgagaagacttgtattcaaaaaatcattttaacctttgataactcttcccaaactcttctcataaaagttttcgtttacatatctagtatatattttttattttaagctattccaaaatttcagcttgggaatacttgctatagcaatctttttgtatgttgacaagcaaatcgaaccctccctccacctcacacacatacttatacttaattcagtgtgaaaataaaagtaacacaagaaaaaataagtatggaaagaccttaaatactgcagttatatttcaccctcctatatcgcttttaacttctgttgccttgtggatctgtcaacttgagtagatttttcagaataaactcacacttttatttctatattacatttgtcacacccctcagaaaatgtggacactatctctagattaatgcggcaactcagtatctatgtctaaatatgcatgtgtcataattatgtttttcaaggaagtattctcttcattagaaatgcgagtgatagtaaagatgcatataattacactatcccgtatggtagtcattagctacacttgacgaaagaaatgtaaatctaaattatttaaaagcaaatacaattaaaaacttagtacatctgtttttactagccatgttttaagttctcagtagcctcaatagctactttattggacagtgtagatatagaacattgccatcatctcagaaagttctataggacagtgctaatctagagaatgacaatacattttatttatagaaaaggttaataccaaagtatgttctgtaatcgttttttattctactcagtctctgtccaaagggctgtctagtacttaatgtggttaaagttacctaatgagcactcaattaatattcttttataatggcaatcatacaagaaagaaagatttgtttctttttcaaattgcttattaaaatataacaatgtgttctattttaaataatgtgaaaactaagattatatgaataattctaatgctggtattatatctatcagaaaatacttgtagcctagttttttcacaaaggtaatttagacaggctactaaatccaaactaaaatgtcacaaggtgaaaactcaactaatttgttattattctatatccaattgattttactgaattgctaatacactgtattttgttttcaggtagacacagcctaaatctgtaagtaatctcactcaactctgaagataattaatttaaaaacctattattgtgaattatacataatttgcattatttatatggtcaaagcttattaattatatatatgcacatgtatgtatgtacgtgtctgtgcaaatacagacacacaaaatagaaatgttgagaatgggtaaatcacatcgtagatatgttttctgtttcactttgaactgagtccatgcaacgtcaagataatcacaactaactgctacaatttagaagaatatatgtatcaggacctcaaattatggaaaaaaaaattgcaggtgaagagagaatgatgatgaactggtgatatttcaaagttatgtgtatcttggcacgatctgagacagaaatgatggatctgatggttttcaagtatatatgtggaatgatctgttggagaccattgatttaaggagatctgtttgacttaagaagggggtcagtacctgctagtttgtttcatgcaggcattactggagagtggctgtactacatggttgaggacagccttacttccaccccttgtccatgagatcagagatgttttcccatatgtaaattttgtgaataggtttcagcttgttaaataattattcatcagatcaaaacaacaacaacaacaacaaaacttccagtatccatgttgcttctcaatcaatcactatgcatcaaaatatcaaaaccttaactgcatttgcgccaagacattttacattctttgacttaggcatgagagaaaataaagcaaaggctttttcagaagacacaaggggctggagagaaagacaaagctgagagtccatacaagtagtatactagaagatacggaaggtacatttaataaaaataaaattagaaacattaaaaggttaacattagagcacagaaagcctgttacctagtttttaaataacaatagacaacttagaaaagagaatgatcatggctaaaaataaaatatgggttctttacagtcaaccagaagaagtatatcacaatttaaagacaaatagaaataaactgacattaatagtgaaaaaataagagacttagagaacagatctaagatacctattaagcaatgataagtaccagaatgagaaaaaagaagagatggaagatttgtaataattaaaacaatcataatagaaaattttccagagctaaagaagttattaatattaattggttatttaaaacgttacccaagtgcaaaaaagaattaaataagtggtgggtcacaactgaaatcccagcactttaggaggctgaggtgagaagattacttgattccaggagttcaagaccagcctgggcaacataatgacacatcatctctacaaacaaatgttttaaaaattagccagtcatggtactgatggcctgtagtcccagccactaaagaggctgaggcaataggatctcctgagcctaggagttggtggctgcagtgagctatgattgcatcgcggcactccagcttgggcaatagcaagaccctgtctcaaaaataaaaacaaaataaaataaaataaaataataaacagggacacatttagaaacatttaaaattatatcttaatgaaatttctgtacttcaatagatgggacagacagcaactttagagtttgagagaaagaaaaaaggttaaatacaaataaatgatacttggactagaatcagactttacactggaaacaatagtagcttgaagatagttgaaacaagaaaacaatggaaactggaagacaattgttcataacctacagagactactaaaaaaagaggagagatattaaagaatgttactatccaataaatccatcatgatgactgcaaagcaaagatcatttcgaaaatgcaaggtttacaaagtttacatcctttatgtttttacgaggacatttctcatgtgttccaaccaaattaaaactgaagtacagttggccctctgtatccatgggttccacatttgtggatttaaccagtcatcgatcgaacacatttgcaaaaatacatggatggctgtgtctgcactgaacatgtacagacatttttattgccattattccctaaacaatactgcataacaactatttacatagcatttacattgtattgggtactataaataatctagagatgatatgaagtgttcaggagggtgtccatagttacatgcaaacactatgccattttatataaataatttgagtattcttgaattttgatatcaaaatgctgaaaccagtgccccacagacactgaaggatgactgtgtaataaagatttcaaaacaatgagaaataaacggtacaaaaaaacagtgacaggaaatacaccttgtgtcgtttgtggtcaaattttatgaagtgatagtgtaatttaagtaataacatgacatcttgaactagtatgtgatactacaagtgaaaacaatagtagccaggaaataaaattataaattatttctttttaaaggattttgcctttgattgaaaataatgaggagttgactaagtaaatcatcttggtgatgagggcattgttcttatttaattttggcgcaacactacagaaatataggcataaaattgttgtttaaaatgggaaacagcactagtaaaatgatagtacaaagtataacttataaataacctataagtgcgggaagagatgcagtagagtgcagtgaagaagatgatgaattataaaattatagacaagggataagagtaaataaaatgataaaataatgaccatcaatatgacaaggaattaaaacagacacagttataagagttattgtaaaaatgaagttggttaaaatgtctcatctaaagatgaactatctatcatttttatatcttcataagatcaagcacgtattggtaagaatatgtgatttttttttatagataccagaggctgggaagagtgtaggtgggcggaatgggtgaagagagattggttactgggtacggacatacagttgcatagaaagagtaagtgctaatgtttgaaagaagagtagggtgactataatcaacaatatattgtatctctcaaaatacctagaagagaggagttgaactatttccaacacatataaatgataaatacttgagatgatggataccctaactatcctgacttaatcattatacattctatgcatgtagcaaaatattacatgtaccctataaagatgtaaaaatatttgcataagttaaaaagacaaaattatctagtttaaaatgcacactccatctataggctgtttacaagaaacataaaaatacaaggtcacaatgctgcgttaatggtgatttagaaaaccattttttaaaaagtgaaagtcacaagaaacataaaaatacaaggtcacaatgctgcgttaatggtgatttagaaaaccattttttaaaaagtgaaagtcaaaataatagcatcaaatgaagtatagttcaagaccgaaaagcactaaatgggtctcagagaaccattgtaatgacaaaaatcacacttcttcccaaagcacagtagtcattaattgctatgccccaaacaattgggtgcattctacataaggtaaaaattactagaaataaaaggagaacatgataaaatcatagctgtagttggtaccttacatacaactcttctgtaatttgttagattaaaatagacaaaaaatacaaataaaaaacaagaatagaggtggtttaaaaccgacaagctaaatttaatccgtattttgtgcacactggaaaaagcatattctcctatttacttgggacatcaaaaattacatagagaggaaacttttaaaagcatcaaaaagaaagatttgataggccaccttttctaatcaaaatataataatccagaaatgtagaagaataatagaatacattttgattcatcatctaagactttcacaaagaatgtataagatctatatacattacctgggaacatgtttctaattgactgttatatttaaaataatacacagaataaagcagtattttttaaaaaagtaaaatatatctatatatactattcattggtaagaatgaacagtatatggaatatagtacaaagagatatctaagactaaactatagactttttaaagactaaattgtagactttttttttgcttcagtgagggaggaatcagcagaatgaagaaatgaagagtagtaaagtttccttaatctacctttgtattaattgattaaagtaatactgcaatacatttaaaataatcgcacagagctctgaactagcactaaagagtagatgcaaatagatacagatttcaaggtaaattgagtctttacataacatatttatcagtaggcatggccccctctaattgactttattgttcataatagacttcacttctattcaagctgcaggaaggcatgtactactaattggctcccaatattatggaagcatagactaagacaaaattcagaagggagaatgaaagcattttgaaacaatttcacatcatcacctaaaaccatattggtgcccctcactgcatacccaattgacagaagagtcgtggcaaagactagtggctgctgttgcccatgaagtaaagagaattatttttaggtgcctgagattcctggagatgaggaaatttaacagccaatggctaatagcactcttatgtgacagcatccaatactcgatatattttaattgatcttaagtactcaattttttttttttttttttttgagacggagtctcgctctgttgcccaggctggagtgcagtggcttgatctcggctcactgcaaactacacttcccaggttcaatttataagcaactaattaaataagtatcactaatgagaaaaatacccaagccaaagtaaacatttagctaaggatattgtaatccataaaaatacaactttttgtttgcatttgaaatgactgcttcaattctccccatgtatttgaagtcactttgctaagctgaaaagttttcctctttggcctggcacattagaccatctttatttccatgcccttaacttgaagggacactaatgacattgtgatatactgataacagtatttacaaaattatctgacctaattccaaataacaagtttgagagttaccctgcattctattcttctttgaaatatgcacaacaatttcatatacctgcaataaaaagcaggcagttaaaaaaacacaactttaggaactcgactaaaagatggagaataacctacaaaaatcataatcttgatgagttcagcaggcatttttttcaaagccaaaggacatattttgctaagtaacttaatagatgtaaatagcaaataacatatagcatagctacataaataagcatatgtgtaacatatatgaatacatttatgtgtgcctatgcagcctcagatgtaaatatagagatataagttagctggtggcagtggtatgtgatttaggaagctaatatgccatatggcattatgtattaaacacttttgcacataggtaagatattaaagatccttgggctgggcgccatggctcacaccagtaatcccagcactttgggaggccgaggcaggcagatcatttgaggtcaggagttcaagacaagcctggacaacatggtgaaaccctgtctgtactaaaaaaataaaaaaattagccaggcgtgatggcggttgcctgtaatcccagcaactctggaggttgaggcaggagaatcacttgaacctgggagacagagggtgcagtgagccgagatcatgccactgcactccagcctgggtgacagggtgagaatctgtctcaaaaaaaaaaaaaaagtatttacctaactatatgaataaactattgaaataattaaattatccataagtataaaatgaaataaacactaattatctgttctctctctctgtctcccttcctccatccctccctctctcatctgtgttgccctgtgctaaattatttccccaaactatgagtccatatatataggttctttttcaccttactcgaggctgcagctattatctcctgtttcagtcatttattccttctgtcccattttgacttcaaagctactaggggcacaaaaaaaaaaagagataattaagtttattagaattacctctttaatcaaagcaaaatttttaaaaaatctccaaaaaaggatttggaaattcatttcataatgaaatataagtaagctttggatttcatgaaccttaaaaaatcaattttgggaatcgagaggccttttgttctactccattcctgactcttggctgtgttgcaggtaaattaaaatgatatccatctgacctctgaataaataaagtgccactgtgtgtatagaaatggttatatttaatattattttcccaaaataatatattttgccaggttataactttgcaaaatatggtaatagtcactgaagaaaaccatttttctcttaccaaagattacgctcaattcttttttaaaagttttgtgaatttaatgacaccttaggcttaatgtgctctactttacaatccagatagtttctcctaaaatagcttgttctctgtcaatgttccaggaaataatagtcattgtattatcctatggcaaggattccaatataaaattgttctattctgtccagaaaatttacaagttttaactctaaaaactcatattgacacaatcaattttcactccattttagatcatatattttgaaaaggtaattaactgagaacttggatatgactgttcctccccacaatctccttgtaaaagcagctacaacagaaataaagtattttaccaaataaaaaataaattttttttcacttctcaaaacttttcagaatacaaatttaattggcttatattatatccagaccaattatttcttaaataataattaactaaaatgatgaacgttagagtcttttgtcaatcacaaataattatgttaattattagtcattatgatcactgggaaataaagaatgtgaaaaaagcatgcataataacattaacgcattttgttaagtttttgatcttgatgcattgtttacaattatgaaaaggacagaaaatgtaatacttctgttttgaattaatttttggattccaaatatcatcaggaaatgatactattatgagttctttatatcaccaaaacaaacaaaaacagattcaaatccagaggatgaaaatatttatacacaagaaaataccattttggtacctttattatttgtaagtgttaacgttgaacaatgttagacaaatgtcgtgataccctaattctactcttttttgtgtattttgtcttgtttttgctcctcacatgtgacaaaataaattcaagaatgttattccagtggataactgttatggggccagtactgcttgccgaacaggccatacatataggaggtgatggttttcatgctttctcttcctcattctgaaacttcaagcaaccaatatagaaacttagcaggaatggtattccttcatgtaaataaatttatctaagttggtggtttacggacattgtatttcataggtcaataacaacattacaaaaaaaaaaaactattagggaacatcacaaaagttctgccctttactttttctagtaaaggacattgtaacaaaatgagaagaaagaaaaagaaaggccattttaatacctccaaaactgttgaaacccataattttgaaagaaaggacaattcttgcattaaaaaactttgctttatgaaaagctaaataaaaaattgctcttttttttcttttccttatggaccattgaaaacttctggaccatggcagactggcattaggataccactgacataaaaatacagaacaaccaactctgaaactgcagggatttccacaggaagatgttatacattcattcattcaatcattcattccacatactttcattaaatacctgctctgtgatagactctatgtcttggggaaacagtgactaacaagatagaataggctcctgacttcatcaagcctacattctaatgatagcagacaaattataaacaagtaaacatgcaaaggtaacatttgcagattgcagtaaatattagaagggaaacgtctagctgatgttctagagcatgatggtaaggatagaatggatgtggcgaacgacataaaataggttgtcgaaggcaggccacctgtggagataatgttcactctgcatcctgcaatgtgacgggagaccagcaaggaaatatccagaaatagaggcccaagtcaaaggaaacataattgcaatgacctgaggtagaagacatcttggcaagtttaaagaagaggagggctttgtagcagattaaagagaccctttcccattagggaggccaatatatgaagaggactagatctcttaattttccacatatgaaatactcgagtgtatctacgaagcaagaaatgaaaatatagtgaccgatattattcatgtttcatgtgtgtttatgattgtctagatactaaccagttaacacattttgagctttatacgggtcacagatggagttatatgttatagataactgtatttgttaggtaattcatttatttttcatcacccagatagtctattaactaagaaagcactaattattatggaaaattatggaccttctggaactttccccagttaatttattctggcgagaagtgcccatgcactgatatccagaaaaacagttaacaatgcctccaaattatctgaacatcttaagtttgtacagatatgggcacttggattatatttaatccatgcatctttcatccatggattagtcaccactaaatatagctttcctctgttttacatgcgttaaaatagctatttaggaattttaaaaactgctcatgattatagcatatggtgctaaatttgagaatgcaatcaattcggacttccatttagttctcttggctgttactaaatgggtgctaaactatactcaaaagattaaataaagggtaaaaatgatagaatgtttttaagcaaaattatgttataacatcaaggctatgtgaatttgtattattcataaaactaaattttaaacaaaccttaattatttcaaaagcaactggatcataaaggagggcaggagaattatcagataacttaccaacttgaaaatattataatccttttattttgtgaaaatcaaagtggaaaacaatatacacttgaatagattttattcatctgttctcagaatatgttccatacaatgagagtcttaagtaatcattgaagaatcagaatgattcacagatggtgcaagtgatttaattatttttaaccagttgttctggacatgctcagaaggatatttccaaccccactgcagaagccatctgagctcccttccagctggtgttccatattttcaaagcaaatttagattggagaaaattacactttatattgttgtgttgcaaacggaggtcaaattgctgtgtataaattcttgttcttttttttcttcattgtatgagttatatttatcaaatatcacgtcttttgtatgattgctatggatttgccaatggtattttacgttttgtgttgtctggcacttaggaggcactagataaatgtttattcaatgaaagaaataccaattcagtgtattcaaaataaaacttgaatttatttctagactcacactaagtgtatggagttaccatttaactgcatcctcaccattattgggaggttcccattaaaaatgaacaaaaaaaggaagaaaccaatgtaataaaacaataccacgatcactacccccatcatcaaagaaaatcatcaacaaaactctgtgttaattcaataagtaaaactacatcttgatgctggaaccctgtcccctaattttataggatcttaggaaacctgcttgacaaattttcacctttttaggctatcataaggataagagataccctttgtaaaaatttagtcttgcatacttcataatgcggaatgactgtaacatcagtcaagaaacataactgatatctgtaatcatttccactatgctaagaaaagggaatggaaggaatatgggcatcccattaatgtccatagtcacaatgagaagtaacaaactgttcccaaatagttctatcaaatgtaataatttttcaaggttgtagcattcaaataaagataatactaactttagtgaaccaagtttcctcatctgatgctaaaaatgagttatatttttttaattttatcagtaacattatatgatagtaaaactgcacatatcaataattcatcacttcattttgtatttatatccaatatttctgaaaaatatattaatcatagattttgcagtcaatatttcctgaagaatgtgctaaatttccacttgatagaaaaatttgacacagtatattactatgttttttcttatgtttattaatatatttgacaacacattgcatgatgactgtagtctattactgtaacattaattcagaagataagcaaatataaaattgtatatctaacagagccataatctaactataaaataattgtgaatagtaagtgtagcttgacacatttattctactatttttatttaacgtgctacttgaagccagtcatttgagacaatattcaagaggtaatatgttgtataaatcacgtataaatggtaaatttgcttaaacttacaagaatattaaactgtaattaacatcttattttatacatagtgatggctttggactagagatattcggaaaacacaaaatcctatgttcatatagtttcttactacccttgatgaattcaattaatgttcttaaacctcagttttctatttggattatttgctttaacttaatagcttgtctttatttttccctctactattcaaaaattgtatacttctatcgatttaatgattagtataaaattcttaacacgcacaagaaattttgcaagttttcattctaagcactaagagaatcttaaaattgctttattcattattgattaattacttattttatgaattaaacaaatatatactgtgtacctagtcactgttttgggtgttgaggacacagcagtgggaaaaaaagacaatttttttttgcattgttgggttggagctctacttctaggtagggaaataaatactcaagaagataaagaaggaaaatattgagaactttcctggtcatgcactttattgagaaaaataaatgaggaaagcatggataaaaagtgtgtgtgtgtgtgtgtgtgtgtgtgtgtggtgtatgtgcacacatgagaaagattcattgaaaaaaacacttttgagtaaagaagttaaggcagaaacgaaaagagccacatggagaaacgggggaggattattttaggcagaggtagcacacaatgcaatgggtgcatgtcagatctgtgaaagcagcagcaaaggggtcaacataggtggagcagaggaaagtattaagagataaggcctgagttaagaagtgggccagccaggtcagatatcccttgaaattcatgaagagttttggatttcacttaaaaatagatgggaattcattgaaggattatgatcagatttaaatatggtttatatttttcaaatgttgtccctgtgtattgtgtagagataggctaaagaaagcatgcgtagatttttttttttctctgaaaatttgaaagaacggtgcttccactgcatttgaggggaaaagaataattttgttttaatcaagtcacgaggctggatgaaaacagcaagacatatatagaataaataaaaatggcaagtgcccaaggactgagcactgaggcatttcagcattagagaagtaggtactacctatggaaactgagaaacaatacatagaaaggtagcaggtaaactggatgaaaaacttaaccaccttctcatgtttcattgatgtccagcatttttctgttttttaatagacactttcatacacggtaaatgtttatttaagacttttccatttttttaccattttctttgcacatcattttcttttgcagcttaaatcttccatcttgtatctttctcctgcttaaagaccaatcttgacgtcctctaaagggaattttatgctagtaaacggtttctgtgtgtctgaaaagatctttatttcaatgttattcctgaaagagagtttctatcagtacacaattctaggttcctacgtggatgttctttcattgtttttgaaaatattattctaccgtcttctggcttctatcattgctctaaaaccaggtaccattttaagtgtcactactttctaaggaaatacagcagtatttaaaattatttctttgctttttttggattcatcagattcatcgtctcatagtgatgatctatacttatatttcttttttttaataatcttttctgcttcagatttgctcagtttcccaatcggagtattggaatttctattaagttttgaaaatcctaagctattatcactacagataatgcctcttctccattgtgggtaggatttatttattcccctttacagctgagggaagcccttgaaaattcagactttaaggaggggttttattttcacctctatattatgtgttgttgaaggtcacatattttgtcctaaaaggtcttgaaaacttcttcctagccattaggctctcaatccaggttcagtttcacgtaagatgatttgatcattcatggcacacagagggaagagaggttccaccatagcccagctgtgtatttaaaacttttaaaaattatattttattcagaatttccacgcatttgaagtgagggggtgaggaattaagtcagtctgtcatctttctggaagctgatactcgctgaacatgcctctacttaaccattaaactgattatgctacacaactagacactagaacaaaaaaactccgtacaaatatttataaccactatgatcatcaacaatctagaaaaacataaaatgttagctaatttcttttttaatccttgtaatatgttaattacaaaattgagctgagaggagaaaaattctacaaacagctacatcctggtgcaacatttcccttaacaaccattattagtcttttgtatttacaattccatttgctaaagaacattctgtctctaaataagaaaatcatttatcttcccaaattctccaaggatgttgcactggcagctgacaatctttgttgttatttcaaggcaaagaagaaaatctatgtggcaattatgcaaagacaatatatttcccctaattttattctcaaaatgagttgcttttattacaagataggagacaatataaaaaatgtgtagcagaccattaaatctaggctcagacattattttacataaggtggtggcaaacagttctgttattacttttcttgtacatctctgcttaaatttaaggaaatcccaaacaacagaagaataatgatacggtgatgttcttcccatttttttctaaagaatattcttatttcaccatcactcaaataagaaacctttcatcaatctgaaatcaaatttcccttttctactgcaactgtctagatgtgaaagtctatagaatctaaccccttcatagaaagtcataatcccattagcatatcaaacgcactagaaagttatagagtaaggaaagtttgcttaatctactgtttaccaaaattgtttaaacactgaaacttttttccttttttattaataactcccaccatgttttggaaagcagtgagttcaagtttggcgtcttccatttctcagatgtatccttggacaaatctcttaacctcatttatgctaatttttcttacagtaaaatgacaaagaaaatgatacttgagagggtcattactgtgatcaaactagatgcatgtgaaaactctttgtgaatgtataatactattcagattcaaacaacttaaaaaagttagtggaaaaatattcacaatatataggtgtttattttacaaatttattcaattaaggactacttttttttcttgaggcggggtctcaatctgttgcccaggctgtagtgcagtggtgtgatccctgctgactgtaacctctgtctcccagtttcaagcaattctcatgcctcagcctctgagaagcttggattacaagcaactgccagcaagcctggctaattttatatataaaacatatataatacatatatataacatatatatataacttgtatatatatgttatatatggatgtatatatgtatatacatgtatatataacatgtatttataacatttatatatacatgttatatatataacatgtgtatgttatatataaaacatgttatatataacgtgtatatgttatataacatgttatatacataacatgtgtatgttatatataaaacattataaaacaaacatgttatatacataacatatacataacatgttatatacataacatatacataatatgtatatataacatataacatgttatatacataacatgtatatataacatgtatatacgtagaacatgtgtatataggcataacatgtatatataaaacgttatatatgtataacatgttatatataacacgtgtatatatgtataacatgttatatataacgtgcatatataacatgttatattcaacgttatatgtgtataacatgttatatataacatgttatacatataacgtgtatatatgtatgttatatataacgtgtatacgtgtatgttatatataacgtgtatatgtgtataacatgttatatataacgtgtatatataacgttatatataacgtgtatatataacgttatatataacgtgtatatataacgttatatataacgtgtgtataacatgttatatataacgtgtgtatacgtacatgttatatatgttatatgtaacatgtgcatacgtgtataacatgttatctgtgtgtgtataacatgtgtatatatgtatagcatgtcatatatatacatgacatgttatatatgttagccaggctgatctggaactcctcctcaagtgatccgcccacctcggcctcacaaagagctgggattacagttgtgagccaccacgcccagccaaggactattttaaataacacatttattgcagcatttaatctacaaacaaggttaattttctatcagccttccaagagcatgtatattttggaaatgtgtactttaattttgtcaaaatatcccattacaattactctgctgtaggacaagctatccattgcaatacaatattgtaaccctcttcatattcatcttttaccacctcacttttatgttccagaagctgtgtctttccttagtatgcctacttctagaagtaaccgtaagagaaactgatgttctgaacgagcagtcttaaactccgaatttgcatacataagtatagggaatataaaacatttataacagaaactactacattacataaccagattatacatcaaagttctactaaatattcattgttcctaaatgaaaggatatctaaataagttatagcacctatgcaaaattctaggtgaaaaatattccattagaaaaatatgttcaaagatactgatatggaaatgaaattggttgtgtttaagtatagaaaagaaacctttaggcctctatgttagcagaagagcaaaaagggagacaaagtgtgagtaacagaagtgataggaaggggctacatcatatagcggatcacaggatttcatttaaagagtaatgggcaggaggggcctgatatgatctcattaactccttagaaggagctctctgccttcaccaggagaaatatggtgtaagtggggaaagactggaagaagaggttagaggttgttgaagtaatccagatgagagataataatcttgtagattagcacttccataacagatacggaggagtgatttgatgcattttgcaggtatatccaacaagagtggaaataatttacatggtaatgtaagagaaaagaatcatgaaggatgtctaggtttctgacttaagtaaataatagtgcaatttaataacatctggagatgttggtagatgccaattaacgtagatggggggtggatcatttatttttcacttggctattgtatgtttgagatgctcattaggcatccaagataagagactgttggatataaaatgttaaacatcaagatcatatacttggtatttgatgtcataacatgctcagctcaagtggaaatgtatttagaaaatggacatttctttttcttcactgaagtgggcttttttttgtatttttttgctgctgttcttggaaaggtcatgtatgtatacatatttcagaggtttagcacttttttgctatctagaaacattataattggtaataatttacatagaacacattatgcacaagccttatatttgttgccattatctcgaataagtcttgtttttatctccctttacatagcatatgtaatatgcaggatatgaattaaggatatgtaattcataggatatgcaataagtcttctatttgatttctctctctttacacaggatcagtcaaacactgcattctcctagtattctgtgttttccttggtggcactgaccaaattttaggattataagcttttttaataaatgttcttatttacagagaaaacaattttatacagctttacatcgctgtctccttccttctagtttcattttattttacacaaatatattgcttagtaattattttagcaaaaatctatagacaagaaattcttagtttttgttcaggtgaaactagctgtatgtctgagaatattttgccttaattcttgaatcatgttttacctggtatttgaaaatgtgcctagcattttgaagatattattcaactgtcttctaatatctattgttgatgaaaagtcttcagtcaatattgtcatcctgtaaatgttcttttgtcttaagtaacccttaatgatacctttttgattactgatgctctgagtttcattcagagctagctggtagacttgtttttattttttccacgttggttgacctttattgaatttgaggattcattaaaatttacatttattccattttattaaatttcattaatatgaaatattgtctcttccccataatccctatttttttcaacttgaaacttatttcacgcagatgtttgagggattaattatattttcatttccagactttgttttttcaaatcttcgttttcactttatataatggcctattcttactggaaaaaaatccatttaatttttatttttgaacattaaaaattacttaatatcctttggtgattatcctcttatctctattttcttcaggtatacattctccttttaacgtttggcatctgataacattgcttataatttttttccacaataatcataattttagtttgtaagcttatgttccttagcagtttcacatgacccttgggggttgtagtggtatcttcattgtataattttgtgtttgcaaatgcctgggctctctgaggttattttccaaatgctacaatgatgtgaggggcagtttagggaaaatcatgccctttcttggcagtcatcagatttgtgtgatatttcctgtgtttattctgtgaatctagagaaaagtatctgcttatatattatagaattaaatttgaaattttcactgaacgagatatctgttgttaacattttaaacaaatgctgcgtacttaattctcttaatgacttatgaaaatattttaaaaattaaagattatgtctattttccaatgttaatatatatacagaaaggagacgaagaaaactttcatgcattgagcctgcataacgcagcaggtgtttgacaaatattaccttatttaatcctcagaaacatccttatctctattgtacagatgaagtaaatgagactcagtttatccctgatcatacagcactcaaagtcactgggattcatattcaaggctgtttatccaagagttaattttactagaccacactgctgtgatagtacatcctatagaactatcccttttcctcagtttacagtccgtgcttggtcttaactgaggaacctagtttctaaaccaacaggaaatatattagaaatgattggaattcctaattaaggcaggagttctctcattttgaatatctggtaaaatttttacctgcgtcctcccagtctcatgcctctttctttatcatctccaggtttgccctgaggaccacaatttgcagataccctctactatgctttggtctgcattcctgtgtggctgggcgctgcctcatgattgttccctcaaagtctcagtccttttctgagctttattactaccatatatagctctgacatggacagagtcccctaaatgccttaattttacagtggttagcacttctctgagtctttatctgtgagataaggaaaattaatttttcattttaaactcactcagctctcacatactaagcattttaagagtaccgcttactatttcaacatgttgctgtaaagacatgaaagatgaactttaagcctacagtttatatctagaaaaacaaaaagggacagttaggaaaagtaaaaatcaaacaattagagaaggagaatatagggggaggtaagaaattctgaagctatggcatatgctgcatcagagccattgtaaggttatatcaaatactacttttcattaagctgttactgtgactatcacaaatgactctagggcgtaagaattgggaaagataactctaatcagtggccacagtgaaattagttttaaaatgcattgacaattggtcaagtataaagatgtatcttgaatatttctacacccacctgtctatctatctacctaccaacctatatacctacttatcatctatcaattatccctcagttctaattaaaatacgatgccaaatataactgcaatattaaattgattattcttcatacagattgtgattactttattatcatggataattaagagttaacacaaaaatagcccccttcacattctgaattttggatctttaatatataaaacttaagaataaatcgtttatgaggaaaatatatcccagaattttactacaattttttaaaaatatatactggttcacacatgcttcctttatttcaccagtcattattacgttgtacaaatatttgttgagagcctactatgaatagggacataatggcattttaagtaagtggtttatggagatttttgatcctgtgcctatttagccataaagcattagcaacttgattagtttgtaacgaattttaaacctgcatattgggtgtgtcaagacctggggaaaattggaatggagaaatgagttagtagtcagataattcaaagcaaaggactcccccttgaatgatctattaaattgaggtgaaactattttattagaattttctttttgattgccttaatctttcgcttcattttgcatctgcagacacaggcttgctggttagtgtaaggttatttatgacacattacattcataacatctaatatgaaggataataggctgaaacattcagccaggtggaattagacttcacatgcaatacagtttcgctatttctcgtattcttccaattgctcagaataattcacctgctattaaactttagggtattagatttaacagaaaacagtgtatttattaattttcttgaagtattaaaagaagtcacaataatatgcaacatacttcccttatatgcttataaaattaagttatggtaactgcttttgacattttaaaaatatacaccaaattaaatggaactgacactatcacagaagaagttcccaagaagtctcatacatgggctgaaccctatgcagttattatttacatagggcaaaatggttgagtatctgtttgattcatataattcaacctaacttaactataaagacttagtttccagattttgacatcctggttttgtgaggagtactttcttctataattacagatgatgatcattcctcttcatcttacaagtgttaataataggaacaaaaatgtacctgtcagaaaacctctatggtttatacctactacaaataaagaagtgagaccaagctaacaattctgaatcgcctttttaaagagagaaccatacactttccattcagttgtttgaaagaagagcagtcactcctttttgttttggctggtaacatttcagtaataacattatctgatattgttcaatctgcaatcaattagcaaccatcttactaggcatccagttcttttatgggcactgtaacccattaagtagttaaaccaggtgtgaggattaagctattattcttcaagtcaatgagataatggcttatgcaggttgacataagatgtaccatgaaatatttattatttatcatgtatacattaagaaagtaaaatcagcatgggatgatctcaggaaagcaatacatattttttggattagacattgaagtaaagtgaatgtatgataaattgacaaattaacattgccaatgttatgaaaaatgatgtagcaaaaaaaattaagatgtattttcatttttgataaggggttttccctgttatctgttaatttcttgtgtctttaattggcaaaattaagcactagtgttacagaagcccaaagtgagggaaaccactcactttcagaatgtacattagaagtttaaaactgtacccagattttttgtctcttttttttttattagtaggcctctgttaatagagtagtagttgcaaacacatacgtgggtttgccagtaacaactcacaatttgtgcaaagttgagtcttcgaaactgagcaaatttgctctcaatttcccgccagcgcttgctgagctggatctgagttggctccactgccattgcggccccatcctcagacaagccctcagcttgcctacgcactgcattcagctcctctttcttcttctgcaattcccgatcaatttcctattgagcaaaaccaatacagggcccagggcagttagctaaccacatcaaccgacttgcaagcagcaaatacttctctcaaaatttcaaaggctgttgtccctttattgtcatcctttgaagtttacaaatatgaaaggcatgactgtcatcctcgctcaataacccaaatattatttcagttatcctttgaatgcttggttttagatattctaattaagtaaatattgaaattggtctaacattttctttcttctaaattcctctggtgtcttgggatttgaaacaatttggagtgataactcattatttattagggaccgtccacatagaatataatttagagggtaagtgaataagttatttatttcctttttaaaggtttgaggaactcaacagagaatgaagcaaaataaaaagtgtaaaataataacagaaaaaaacatatttagacaatatgcaaataaatctatagagagtgaacactgatgtgtgaagatgctctgatgaaatgaatgggctaacatgagtaagaagtcgtccatataccgataagtcattagttcatctggaacaaagatacacaaagtcaattacaattttaccagaaaacacatcacatttcttaaatcactttacatagtctaaaacattttattcattcaacattacgtcaattgaataacacttaatacaatacatttactgaaaacaacacacaatacaaggaaatgcatcaaatcaaagagaacgttaatagaaacaagaacatcaacattttaaatatgatcttcacaggttaattaaactgtataataaaatctggtattgacattctaaaacaacattacctttattttcctttcatctctgggctcaggtaggctggctaattttttttcaatgtcatccaagcatttcaggagatcatcagcctgcctcttgtactgataccactgatgagaaatttctagagccttttttcttctttgagacctcaaatcctgttcatggtgcagacattattaaaatatcaatatatatgtatagtgcacttctggctgcagttatttatcaaaataatttgcgtccctcatctttttgtacaacttaggttaaaatcatatttaaatgcaaaatatacaaagacataattaaattgcctatgcatgaggcgggacccatgtataggaagctaagaaacctgaataacacacttaaagtattttctcttagcatgttcaaacttgcttaaaaattttgtcacattcaattgactcttaatgagctaactgttgtgtagtttatgtgcaagagtttaatatacgaatacaattgacttaactagatacaaactcacaaacctagtgagtttgtatctgacttaaaataggtaaaattctaaaatgtatatctttagccttggggctcatcaacaaaactttatgtactcaaccaatatacattcatgtttttagaaatgcctacataagagtttcataggccattaatattttatgattagaaatataaagccattttagttgtcttataaactgttccaagctgtatgtgtagaagtgtcaccactgttcgtatattggtgaacataactaataaaaaattatgtgagataaatgcttctccttccaaggcttgcatagccacatttatcttactataccaaatcatgctctaaatgcaaaacaattaactatttgaaaaaagaaaacagcaagtgcatgctttcaaatcaatgtgataagactaatttaataaatcaacaatgggaggaaatcagtcatcatgctctttacaagcacactcaatatcttctgtgattaatagaattactcaaaatgccattttataattcatgggaacataagctctgcatgcagctttcatttctacagaaagtagcaattagggttttattcacaggtttaattcgagcgaaaaaataataaatatcagggaatttctaaaaatttcattccattggaaaattttgaccttctctaaaatatttcataaggaccagaattggaactatttgacaggtttaaaaagttattgaatatgttggtatagattggtttggcgagtagtgttgacgattttgattaatcacttatagcctgtatttgcaagaatgaactacatttcattatctagtttgtttaaaattgggaatttaaaccttgctgtactttatgttttatgttgaattttcaaaccttctgaggagtcagatcgaacgctgcttttttcaaaggtagcaagatacagccacgtgaattagagttgagccatgccttatttgtgacataactcacatctttgccaggagaaagggcttggtggtcatcaatctgaaacatctttcatttcctaagcacaaagtgatgtataatatgtaaaatatttagagatgtcatgtagatttctttagaggaatgccagatgaccattaaacactgctattcagtaggacacacaccatcatacgaccagtgtagatacttctgaaagcttgctcacagttggaagggtgtgagttacatagcgttccgattttctagacacattatggtgtgcttttgcactccctcgaggaagaggccttttctgtttactatatttatcagcagttaccttcagaacacctgctggccaattagactttccttgtggattccttgcaggcacaatattgtgtaattacattctcagcagtgtttatttggttgactatagggggaaaggttttattctcttatttgcatgtagaaagcagactccatctacctgctaggtggatccaccttcataactacatagctcaaaagagtgatttacaaggaaaagctcagcaattaaaagtattagaaaatcagccatgcatgcaaatagtgattattgcaaagcatatacaaaaaaaaagtttcacaaaactttccacatgtctagtctcaagaacttcctagatattattatagaaaaattaagtttatcctgctcttcctgcacaaaccagatgagtcacctggggacttgaagccatacactacactgcttaatatgaaagtagcagttcttattcaagggcactaagattattttttaggattcctacataaatgaaatttgactttgtagatagttgcaaagagtgactttcttaaaggcataataaagttttaaaaataaataaaagaatctagggcttattaaacaagtatcaggttaccaaaaaattggacctaatgcaagcaaaatcaattaagtaaagaaagcaggaataatggatacatgtagatcggttattctggcagttaggcaggtttttttcaatataaagtagctgataaaaataaagcacattagaaaattaaatgtataagtactatgaatgcattcccatctttcaattactacttagaaaaatatgtctttaaaaagccataacttttaagcaacacatcgttcaaaatcaaataccactcaaaaatgttaaataaagcatacacattgaacagaaaaagtgagtttctgatgactaagtctgaagcagattttattaatgcacattatattttaccctatatattaaaaaaaaaccacaggcaaggtatattataattttagctctaataccttgagagcattatgttttgtctgtaacagctgctgttttatctttatttcctctcgctttctctcatctgtgattctttgttgtaagttgtctcctctttgcaacaattcttttacagtaccctcattgtcttcattctgatcaaaaacaacaagtacagtcttcattttggtttttaaaaagctgtacattgttaacagagataataagacatgttatttaaacacacacaaaaatccaatttaaaactttcatggaatgctattataagatactgtgctcatagcctttcttttacatttggtacttgaggtttcaaaataagtttcctcccatctagttgtaaagaacacatttttaggggcacctgtagaaagatgggggagtgtggtacttcatcatgtcagacaagtcatgaattactgtgaaagtattcttttggcttttttagtgtagttctagaaattaaaacattagagaaatgagctaaagttatcatttataatgttaactgatccataaaggaatacagatgtgtatttgtgactgagataacagcaaatctgaaaatattaacacacaactacatgaaaatattttgatttaaatgtacactaattcctatctaataactcctgcttcatttctgaaacctaaatgctcaatattaataggagaaatatcaggatattaataaaaatcatgtgctaagttaccatcaaataatttctaaaatatgtcatatatgcatgttaatttaaatacgatcaaataatactaaaatatggactggaaaatggctttaaacattttcaatgggtattttgttcctttaggctgcaagaacaatatcttaattttctttacttagaaataaaatgttttgaataaatgctggtctaatatagtcgcatatatgaccatgtgatttttcacctttagttttctttctttcaactcagaatgtgaaaactttgtatcaagtagtctcacattgtaatggtactcaaggtacactgatgacataaggaaaacaaataataaatttcaaaagtcacaagtatttgtatgtgtgtattacaattcaaggaattagatgttatatatttaaatctataatgcataaacttcaacacgcaactgaggactgattcattttgtatgggggaaagggattatttttgtcagagactggtcaataatctaaagaaacatacggcataatatagacacattatatacttatcataatatagacacatcatatacttatagtctgtaaaagactttacttattttaaaaggtgttgtaaaagtctgtagcattttctagggctgaggacaaaaacaacaaaaaattaaaaaacccacttcacttctttccctataccagttgagggctctagggcagagttggggtcagcccaagaggtaatcagtactttttttcatcttggtgccctctagtttcttctttgacctgaagtagagattgctgtaactcagcaacttggaaagcctcttccgtctttccacaagctgagttggcaaggccaccaaaccccatacatggggagtattgattgaggcagctccaggaagtgggaactaagattggtgggaatagttctcctattgcttcacacacttattacctaaaatttatatattgtcttctgatgtcactttcaagcattgtctgagaaggctctagcactggtaattgtaaaggttaagaatgccacagaggtgatggcagtgaaagaggggaaaaaattgtgaaaaggaggatgaagagagaaaaaaaaagtcagttaataaggatgtgatgtacaaatattcaagccagagagaaatgtagtagatactttgaaattagttgggattgaaggagaatattctgaggttgggaagagcacacatggtcatatttctttactcccatgaaataagcagcatgaatttatacacattttagacatataatgtactaactaaacaactatttggtaaaacaactttgtgggaaattgtaataaataatgttcatattatgcattattctctcttcattgaaataaatgttatactaccaaaaacattgctgatacaaaatgtcagtcatctatgatagttgagtattttattaaatttttagtttattttatgattcgactcttttttccaattacattttgcccttgataagttcaaaagtaggtcaggtcaaaagaaaattgctgggctatttattagaaaccgtaagtgctcctatattaccataccatagtaattcagcatttgtaataaaaggccaagaatattctgcatttataaaattcattagaatcataaaatgtgtaatatgtgctctgaaaattcagttggagacttatctaagttctttccaaatatttatttccactcctagttcattcacacttttatcacaaccaatttaccatatctttattgaagtcttcctctttcagattcaccccctgctgaatttcagcctccagtggttcaagcaatttttgtatatctgagttaaactgctccaattccttcaaaggaatggaggcctaaaaaaaaagatagtgctactttaaatcaaaattactttttattagaaacataaaccaaaagaaatacatttattcaacctcctgttgctaaactaatcacatgcattatgtttccatattatgttttatgaagggttttgaaatacaactggaaaagtacctgaggatgcaaataaggagaaacatttcacatcaccagagctgaacatacatgcaagatagtacaattcatcatttggtgatatcaacaacagtcaatttacagatacatttgaatgggctaatttttaatattctaaagtcaaatttgaccttattttaaatattctgatataaatacatttgggtaaatatgtctcatcagaaattgcctcatttatcaagtaacagtaacctcaggtagaaatgcagaattgtcatcttatccttagaaaaactacatggcaatctgctcagatgttttaaatgacatttttagcacagcacaattgacaggcatgctcttctaagacaatgccattagcttgccttaggaacagtttggttggtgatgcaaataaattcaaacgaatgaacctaatatatttcacataaagaatctatgcttttcaaccttgtaaacatcagtttctttacttttgaactgataatgaccagtctaagaaaactttaaaatctcttgactttctaaacaaaacccttgaaaaggagtgataagtgaaaagacatggaaaatcaaatatatattcaaaaaagtgggcaaggtttagttattagattaaaattctgttaataaaatacattgatactctctcaatctttatgctgtatttctttccattaaaacactagaacatattttatatgggatagctcttgaaaacccatagatgacatacagaaatctgattttctttcagagctaaaacattttacttttgtaaaaccaattcaggaatgacccccgtgtcttttgccaagacgattacattcatcaagtttggtccccacctacccttctccagtcacattcccaggaagaggttgaatttttattagatggcaacttctggtgaacaatacggataagtgtagaagaaaaactaaatatctaaaggtaataatctgtcactattgaagaagtgaataatcaaattctattcatgatgacatgattctcatatgcaacatgaataaccacatatcttctaggtacttctacacacccctgaaagatttatgagataattttaagtgacctattacagtaccagtttttaaatcctaatgatcatttgccatttgaaatatcataagttatttgaaccagtatagattggtagtggtacaaacatgcttaaagtttcaatgtctgtattattagcaattacggtacaataaaatcatacactgtttagatgacggtaaaagtaaaaagattaacaacccttagaatcataactatacaattatcaatttggtgatattttatgttattaaatggttgttcacatttgctaatatttaatgaaagcaactatgttctatgtgattttgtgaatacataatgataatgttgaaaataacttttattgtgtacttggatgtcagaagaacataggtctatttacagtcagatttacctgttttattccaactgcttcttctctagctcatctctccatgaatttaacttctattaatttaagatacaattttctacgaatttaacaattttttatgccttccaagtcttcaccctaagctgttatctgacttttgaattcccatctagactctccaatagccagctgaattttcacctgaagtttcacattcctagtatggagcacattatctttcccgcaaactgcttacaatactaacttccctagttctcttaatggaagaccatttctctcagtcattcaggcgtaaaacgtaagtcatgctatttttgaacatctcactctaatgtctaataaatatcaagtaagtgtcaattgacttgctatgatccacttgctttgtattcccagagactccatcgttcctggtccttacacaaaactaaggcaataagctttgaaaagatgtaaaatctcctttcagtcaaaccagttccagcctgtgcccaatgatcagcttactatgtttcaaaaacctttctttcattatgctatttatttgctgaagaacctcctgcatctattgagtataaatagaataaagtccaacctccagcacagtagtcaaggcttctcctaatcttgccccaaagacttgccagccttatgtaagtgttcctaatatagacctttttttgcaggccatttggtgatcttctgttatgcctccttcaatgaccttagaatacttttcatcttctagtgaagaacataaacttctgtatgaaaatgcatagattgaatctgggctctaccatttactagctgagggaacttagacaagttatttatcctcattgaacctcagtttctttataacatggagataagatgaatatctacctcacagggctattactaagatcaaatatgttagaatggtgtctggtatataataaaagcttaataaatgttgactattattttctctcaaacttctatgtgtccatccaatataaatacatgctctataaatcttgggtcttattttgatcctctcaaaatcctaatcatccattggctcaggtcaagcccttcctcctttgaaatctatggttttaaaggataaaatacatgcttattgatataatgagtctttattttaccaagggatttgatgaaatcataacattgtaatggtgaacatggaggattttagattccagtttggtagagttacataatcctgaagaacaaaactacagattaatttatctgcggcaatataaaaagtgatatcacagccttgcatttagtttacagggtgcagttttttttttttaatcaggaattatttggagacagaaaaggcataccacagatacagtcagtggggtgtgttccctagacatcctatggagctgagtttctcatgttcaacctacagtcatttctggtacatagtaaatattcataagtaaatatttcctgaaaaaataaatgaacaaaagactaaaaattgagggccaaaatagacatttcaaggagcttttttagtgacatggaattttaaataacacaatttctatgtagaaatgtcaaaagacctgactggttagcattatatgagtatgtatattaactgctgcccaaatgctaagcaacatgataccaccaggtaaacacaaaaaagggggaagatgtaaaaagagctttgggagagactaccaaaaactgaagtgctaattattcaggcaagataatggaaacttagacttctttagttcaatgtgtagggtctaaattttccaatgaaagactaccgtgcattttgtttaaaaaaattaggaagattaagaatttgagtagttttattttgtgtagtttcaaagtgattaactaaaatcagtgggcaaaaattatttggagcctaaattttaggtttatataagaacaactgatgaggactgcaatttttttaaaaacactgattttcaagtaatgctaaatgtttataagcagagactagatgaggatgtattcagtcacattttaggaacaaaatccttttcacacagacattttcttaaaattttataaccttacagtaagttcttgtctctaaattcaagtagaacttttatagtagtgcagctcaatagaaatataatacatgccatatatgtaattttaaatattctagttgccatagtaaaaaacaaaaaacagataaaattaattttactgatttcactgagatgtccaaattattgtataaactcataatcaatacaaaaatatgaatattttacattttatattctcttcaaaacccacacatattttacacttatttataaatcttaacatggagtagccaaatttctaaagctcagtggccacatgtggttcatgaccaccttattaggcagtatagagctctattaaccattatactcataacattgtaaagaactaatatctcataattactttgaataaaatagtaatgttttgtttataacttgtggtgaatttagattattcttacgtcggtcttattatcttgcattatgtgttctgagtgaaattttcaggcagtcctcggggtataggaaaaattacgggagtgggattgacctgttatttcaggagtttctattctcatttatgtgtatctcagcttgtgttgcactgctttcttatagacaggaatataatattatttggctttcaaagatatatgcttgtctctctaaataaattttccatccttaaagttggcaatatgtcttatactactctattttccagtgaaaacactgccttttattttatacaggaaaaggtgcttattatatcaatcggtagttttagaactacctatatattaatttaatcaaccagtgaccaattttataaccaaaataagtttatcaaaccaattgttttagctatgttattggcaagatagcaccagccatttgacagccatatgattaatagtctttggacacaaagagatgaaaaaaattcattgcttttcttaagagttcactagttcagcattaggctatgcccattctaaaacagaaaacactttcccacccaattaaaattctacatgtcattccttggtcttccctgtctttgtaacttggaattcttatgcaactttataaaggaaacatgtaataagaaagcgtttataatttaacagctcattcttgagtcaccaaattttaaaacacaaagtatatcatgcctgcttttcaattcagaattatgataaattgtctaaaacagttgaaagcaatggctgataaatcatcttaattattgggtaagttacttctattgactttaaaggaaatagatgaccacaaaagaactggaatcacaattaaatcacacaatgttagacagtgcacacaaaataggttttagttatatagaaaataatcaaacaaaagttataatattgcatgagaaagtgtataccaagcataggttttggacacttttaattttttacttaccttttcattttaagagctttagcatgactgtgcagtcatacaaaatacatataaattagaagacagggaagtataataaatggataaatggacacataaagaagagacagagaaaccgagaaagacaacactttgttttccttgattttttaatgtttcaaattgcttaacaactattaattgtgctttgttggattatttaaggattaatgaaatttaaggctttgttgaagttttggcattaaagctgaattttataacaagttaacaaaggataacagactgaagaaaagcaagatcaattacaaactgattcattgtaaattgaaagcattcaaaattactcagatacactttattagttttaaaatgtaagctttccttggttaaatattactttggcatgcacagatacactagcataataacgactgtgtttacacagacagcaagtaaacatttgttaatctggactatggaatcttaataatcatgataaattaccactatattcaaatcacactaaaacctaaattgaaaataaataatccaagtgctacagattggtttaaaattgcttcaaatccatcagtctcctttttccattctgcagctttgaaaatttatttatcattacaatattgatatagaaaaataaagaattcatggaaaccaagatgaaaaatttcaaggacaagtaacacactatagtacagaaaagacagactactgatatgatatgaagagttatttcacatcattctatctgtagaggaaaagaacttacaaaaacaaataagtgtattggaaagatactacatctatgctagaagaaagattatttaaaatatggtttataaacttatttattctattattttaaaattattagagcaaacaagaaaatgtaagaaatattatttttaaattaaataaattgactccaaatagtgacatttcattggttgcattcttttgagaatagataaagtactggtttacctttaatgctttgataataaaaatgtgaaaatgtgactaatttgtgaggctaattagaggatattacccagtagatttcaattgattttgtatggatgaggttaatttcatgcttacacattttaaaactggatgcaaaatatattcgtgggtcaagaatctgcttcctactgtcgaccttttataaagtttaacttagaatattgccctatttcatgattacatgactttttggagtaggaaatgaattaaaagaggaaaacatttaactctaaaatgtatgggggagacagacaaaagtaaaaacataacactttaagcaattttgtattttaaactttcttttcatttacttaggttgttttccagttttatttcttccattcccccttccttcttccatttcttcctccctaccaccttttgttcttgtcatttttaatacaaaaagtataacgaaatcactgtatttgaagtgaaattgggtatgtttatactaacacatagtagaccaacaaaaactactttatgacataaatagaggcagtaaactatgctgagtcagtgtattgaagtggacaaagcaatggactgagatctagtatttgctaaccacactgtctaactgtgagaacttggtcaactcactgacactctcacaacctcctataaatatctgaaagtctctggtccaaagcaaaattgctttacatctactgacactgatcaggggactaattttcctttatcaaaggagaacaatcaagattcaccaaatagctttaattatttcaaatgttatgctaacaagacccagatagttttatcaaatgacactgctcaccaaactcaattacacatctactttaaaaatattttacatggttaccaaagggatttattagcgaagtttcaatggacttaaccttgttatagggataaccaattacacatgtggaaaaaataagctaacataagaattatgttgttaggttcatatttttctgattcattttagtaaaataaaatttgcagatattatacagtttgactagtgatctgttactattacctgaagatattagttgtaaatattacatatttaatgctctacaaattatgcaatatttacaagtcttcatctcagttttcatgtttttatagaaaattttactaaaaatgaatatctatatacctacaatgtacctacaaaaattaaaaaaattaaaatttaaagaatatatatagcaagaatactgttccaattaagatacaatattattttccatcataggtgttaagttataatacgatcagaaagagactgcaaaatatcaatgtatttgcattgataaatctgactacagaaaattaagctttaattaaaaattttcaatccaatacatcttcattggaccttctagatcacatttataaaatgcatcatttatttcccaccgaagtttaggagagccaaaataattaaatcactgcttaattattttccacacatagaaccatattttaagatagattaggcccaatcatgtgtttctttttcttatatattctacattacatgggaaggtcactgactctctcacagcctcctataaacttgtgaaagtctcttatccaaagaatgattacttttatatcttctgacactgaatggaagtaaaaaaaaaaaaaaaaaaaaaaaaaaacttggtaatttacaattattgcagcaatcaaacaatgaatatttaagtatttgatgcccgattgtccaaatctcatattacagttgtaatacatatatatagaaactgctacatgaattttagcagcaattttcaaggcctatatggaaattaaagaacatatgccagatatatcctatagcaaataagtcttagtaaaggatcaaagtcagagaaaataatttcacttttttctggttagtatcaatttcagaataaataatttaacatttcagctccttagaacagtgaagtatatctaaatctctagaaaaatacaatctaagcaaattttatgtagaaattacataatattttgtaaaaagtaaaataattgcctttattaatatgacacacctaaagtttgtttagtcaaaattattttgcagctaagtattacaacaataaaaatataacttgatgcatattttattattgaaattttttttaatttttatttttgagatggaatctcactctgtcgcccaggctggggtgcagtggtgcgatctcggctcactgcaacctccgcctcccgggttcaaacaatttccctcctcagcctcccaagtagctgggattacaggcgcccaccaccatgcccagctaatttttgtatttttagtagagaaggggatttgccatgttggccaggttgatcttcaactcctgacgtcaggtgatctgcctgcagcggcctcccaaagtgttgggattacaggcgtgagccaccgcaccaggcctattattggaatttatatgcagactttcctagtcaatcagagttaaatttggagtcatttttgaattcatcatcttcttgggtccttgtatgtaatgacttaactctaggctacctctaaatatctccgcagcagcagttctctaagcgtggtccctagaccttcagcatcaatctgacctagaaaaatgttagaaatgcaaactcttgtgctccactccagacctagtgagtcagaagctctgagtgtggggcccagcacactggttttaacaattcacccaagtgcatacaaaagatttactgatctagactgaaatttcctttccactcccatagctatccctttttttgaggtcatcagtgtatctcatctagactactgcaatagctcccgaacttcatgtcattattcagtggaattctcctcacaactatcactggactaatttctcaacagtgcatacacagatacacacacacacacacacacacacacacacacacacacagagcacatcaagaactcttcattgcatactgaattaagcatgaatgattagtctggctgtccatgacctcttcacactgtgtctagccataatcttcagccttatcatccacaactaagttttatcttccatgccctctactctgaaaactaaaggaactcactcttcattgaacacactgtatgctcctaagctttctcatatgtttatgccgaattgttacctcctctgtgttgctggagtgactgctaaactcacttaccatgcactcactctcaatctagtatccatgaacacatcttgccctatcatcaaacagtaagctccttgaatccatcgtattttacctagcaatagatccccctcactaccaaacactgttatcggaaaataatatatggttggtgagaattcatcctgattaatcccttttctcaagtcttcactcattagtgcttttagatatacctcaactagcatctctcccaaattgctgactccccttctccaacttggcttctagagggatggagaggggtagaactgtcataattaatatgaataaataatcagtttatttttgtcttcccatgccccttcctatacttttgtctcctatcaccttattttcccgatggtatccacttgccctcagccatgccactatactccgatgccctaaaacagagacagttgagacaaggagtctctcctcattgattctgtcaatttactcagggttctaatattatctctgattgactgttgcaattctgatcctctccattaaaactgccatttcctcacattgatttcacatagattacgaaaaaacacgcttttttcaaagtcattggatactcttaggtaaccttaataaaatgggaaaaggcagcatttttatgtattttaaggggcgtatgtgggacaaacataactccttagtagttcttaaattcatccacttcattatctttaaggctggtctttgtcatgaaaatagcaaagacacgattttctgactccagtcgattacagcagagaccacagaaaatcagcaattctttcatttttttccatcagtttttgtctcaaccccccagattcggccattcaagtgtaatatacgtaacgatggaaatacccattgatattaattatttttaaccatttcatatctatacactgattaatacattttaaatgcatgtttttacatatattacataatttgatcctcattacaatctttagattaaaataaaacaggcatcatctcccttattttgtagctagaaatgaggctctgagaggtaaagaggcatatccaaaatcactaagtagtaatgtgctcagctagtgctcaaagcaggtcttgtgtcttgaagttaaggactttttgctctcaccatactgctccttgctgaggccaaaattaacattacagagagctgcacttggacagtcaagtcctcagccaatctgaactgaggatccctttactcactgctttctgggcttcggaatttcttgtcatgaacagtcctggcaggagacatgggagtaccccactttgtattcttcaccaaatagtaaatctagacaccagtgaattttcagcataagttatttctctattcaagggctctttagagttatgttctaaaggctatactgaaattactgattacaaagagtctatgacctacccgtgttcaatccaaatctactttttttatcaccatagtattttttttccccaggttactcttccatgaaacttagacatagactcaaccatagaaaagccatattctaacctaatattatcctgtataacccctactataaagaaacctgattttgagatcaaaggctaccccctaaaacctccagcacttcagcacttccctactccagagcaaacacacacaagacattaaatgttttcaatttcttattgtaatcaacaaaagattactgaatagccaaattttagaacgagcagggatttatgaactaatctaatttagaaatttcaaaccatgttctatgagcataatttatacttcctgaattcaatcataggaaggagaaagataaaatggcagatatttcccccatctagtaactctattattttccaatttattaatttaattttaaataatatgattttaatattaaatatttaaatttaatactttattttaaataataatattttgggcaggataggttttcttttaaaaattgttagtctattttaacttcctcatcttacaaacaatgaaatggatatgcagaaaaatcacatattctggctactactgaaaaagttaggcctaaatctcaatcttctaaatccactgttttctctggtgagattaccttctaaatctattgttctctctgccgagatcatctcaccattatttgaacatccccatgaagatgaattagtgttaaacatattttatgattatactaagtattcatttctgtttgaaaacatgtatttcttaagcaaggatctttatacccttgtatcttctcaccacaatctctaacacaatggaagctcaatcccattagctgatgcaatgaatatataagcaaagtgtcagatatgctttatttctgtgtttttcatttcatcgtgataatagagcataattatctcttcagagccctaaaatggggtcattgttacactcagttgcctttactaatttagagaaaaacaaatactttgaaaagcaaacatgtgattattttgttaattaacatataattgaaaatctggggccaggcacagtggttcacgcttgtaatcccagcactttgagaggcccaggcaggaggatcacttgaggtcaggagttccagaccagcctggccaacgtggtgaaaccccgtctctgccaaaatacaaaaattagccaggtgtcacggcgcccgcccgtaatcccagctacttgggaggctgaggcaggagaatcacttgattccaggaggcagaggttgcagtgagctgaggttatgccacagcactccagcctgggcaacagagagagtctccaccacacacacacacacaaaataataataataataataataataataaatgaatattcactggaaatttcttatgccttatgtttctagggaaaataaaagaagttcatagagtggatcactttatgcatgatttccagaagtatacttacaaattcatgcagaatgtgaaatgaaaactcacaaacttgtcttggtcacaaacttgtattggctgggtctgtcacatctgtggtggagagcaaattctacccattttttaatatctgtgaaccacaatcttgtaacacaatttatccaaagataataccttattttctcttaaatattctatagcttagtgatttattaaaatgtgcatgtgtgtgtgtctatatcttagtaatgaagtagtagcattttttaaggattgaaataaatctccattcattgtcttgttattacataagccattgatatctttagaagtaaaaacaattgtctttgtaagtaacaatacattctttcaaaactttaatcaattttaagagcctgtcacatttttttgcaggtaataatgactgactcaaatatatatatttgtgacagttaactactaagttctctcatgctgtctctctccatatgtagagaatatagccttttaaaagtcaactatataaggtctctatgtatggagagagagagtacaagagaactaagtagttaactattaaaaataacttgcaatgaattaaggtaaactaacaactttttaatttgggaaggtgaattttgaagggtaactgtgtctcatgcatacaagctaaactatttagaatttatcatgtcacatttcacttattttgaaaactactttaaatatgtactattatataacatgatgagacactgtaatgccttagaaagtgcagcaattgtgaaaccatgctattactggttgcttatatctatcaaaatattttttgaaaatgttctatttttccaggaatcaatacttacctgacatactgcatcatattttctcataaatactccaatgtttttttcatttcagattatttctaacaattatctatatacctaaatacatatattgattttatatacatttttatgtttgaaagcatatcatatatattgaaatttatcaaactacagtatataaatttctaggtaattacttgcatttcaaatcttcccaaagagctgaaattctataacactatatttatacatttttgcaaactacttattaaataagactttctcttcatcaaatcatacacaaatataaagtctatcacgcaaaagttccatattccctggttcttcttaaacagtaatataaataggcatataaaattacaaaaattaggatatgtaagctttgcaatgatttgttttcatggcgtgatcatttcattatagcctaatgaattttgtcacagtgtctacaactagcaaaagcaagttaaacaaacacacttgcacaaccagtaaagaggtaaaaaaacaccctagaccgtgcagaagatgtacaagacctcattttggatatttgatccacattacatacaagcaatattgtatcagtactgcttttggcaaaatttatcggtagtgctttatgttgatggatgacttgtgtgcttttggttttatttatttttttggccttcagcatgctatttgttatttttttctgtaggtgacccctgaaagtacgtatgtaaactgcagcatagaatgcagtcctagaatatctatggcagcaaaagatgagagagaaaaagagacagagagagacagagagagacagagacggggaggagtggcgtttatctcccattataatcagtggtaaaatttccttaaatacattttggcattcattttccttttgaaaaccttgctgtggggtctacttgcccctttcagagtactgcgcaaccttcgcaagagaccatttagcacaagtttccaccttggagtagatcttcctacctttccagtcttaattctgtgtgaaatggctgcaaatcgatggttgagctctgagatttggggctctactaatttcctgcagtggtcaccgcggtttgccatcaagtttgctgcttggtcacgtgtagagtccacctttgggcgtatgtcattcagttctgcctttaaacgctatattccatgagcaagagataggacttgaagttagtaattaatgaaggtcaagatagaaaaagagagccaaacagagcgagtgagcaagtgagcgagaagagtgagaaagagagagagagaaagtaagaaaatgagagcaagcacatgcagaaaatacaaagggagataaaaccacaacttccataaaacaggactaaaatgaaaatgcgtgtgatttcagaaaaatagatcaccgtccttaagtttgatgcatgtctatttaaaatgtttatttagtccgaggaaggacagggatgttttcccaactatgttgttgcaactatcataatatattctatttagtcttattttattatatcgttactgaatttaatagttgtggaatgaactaagtatgtgctcaggaggtcaggtagctgaagaacacttttctattccttcctagcactttcaagttcctctttattacattgagtgtcataagaaaaaaagtgattttctaacacatacgaattttctgtcacatacagaggtactgaggaatgttcttcctgacctgccgggtcacagaggttgaagttaaataactcagaccctattattcaaaaagccttgaaggaaattcaccataagatgacatctctgactatacatcaagggataatgaagagcacaatacagatccacatcaaaataagcttcagacaatggcataaatgtgttttggggatagcctggaatgaatttatagtttttcattaaaggtatatcgtaatctgtggaaaatatcagaggcataaaaataaattgcatagaaagaaacataatttttgagttttctttaaatagtaaacaactaatcaataaatttatcaaacattgcagcaaaacaaaataaaaaatgtttattgaaaagagagctgttaaaattcaactctacctatttaattgggaaaagagacatcatcaaatagaaacaatgtagtgtctataaggtatatttgcgtattacacctctcatacccttttatcggaatcattttttaaagaaaagattaagttccccttgaaaaagaagacagggcatcctaacagtcagttttgagactaaaagaaagaacccaaagcctagtttacatgtagttaaaaatgaaaacctcagctttacataagcccaacattaagactaattaccaagatttggatatggcataggcaaaaaaatcagctgactggatttcaggtgttcattcagatgggctaaatgaatgatagtgtcagattgttctttgtgttagacacaagaatgtagtaccaccattgacaaaggcagaaatttgcaatatgatttcaaaataaatcttggaatatctttctgaacggagtttacattgggtataattaactgagtgatggatttgaacagaaagtcagattacagaactcttcaaaatcattcatttccattcaaagggggaaggaaggaaaaagggaaagataaaggaaggaagaaaggattgttttactcttattaagacgtccttagtatcttttaggacaaagatgattgaagtaactggtgtacaatttggacattacttttcatattttatttgctaccttaagcacgtcttctttttgctggggtttctttttctctgattcatccaaaagtgtgtcagcctgaatgatccactttgtgatgtggtccacattctggtcaaaagtttccatgtgtttctggtattccttaattgtacagagacataccatggcattattggttagacaatattcttaaagaatttttcctatgttctaaaatgtttaaaagacaacaataaagtttcattgagattagttttaagtggtattttcatatagaatattgcgtaaatataaagaaaaatatattaaaatattgttatagatattgaattaagagccagcatatacgtagaattgagaaattttcaaacacagaattgttactggtcacttatgtatctttttctcgtgacagagaagggtgtaaaagcttctagccttttctcttaccaacaaaagatttaaccactcttctgctcgggaggtgacagctatccagttactattcagaagactgagtttatcttccaccaacgtctccttcttgcccaaaactgttttcaaggcctctcctacctctgtgatactcttcaggtgcaccttctgtttctcaatctctttttgagtagcctgtgaaaaggagagcattgaccttcaagtaatgtcttgtagtcttaagatttaatgcttatgaaacggctttctgtatggttactatgattctgcaaggttttaaacctataactatgtattaatgaatcatgaaaaccataccatatatactgaagcttcattgttgggtaactatgaacatatatatgtacataagcataattcatgtcttatttttcattataaatatttaataaacatacatattgttcaactaaatatatttatatttatttaatttatacatgtagtggctaaaggcagatatttgaaaatccatccacaaataagaaactgcccttagaaaattctacagtatggtgctactgtatttctgcagcagggatttttttagccttttagtgccatggatctttttggcatctgttgaagcttaaaaacccattctcataataatgcttttaaatgcataaaacaaaatacataggattttaaatgaaaacaattatactgaaatacaatgtgcaacacattttttaaatatttgtgatgtagtaatacatgttttatttcctaatatgttaattaacaagatctagcatcaggtctttaggataatttcaatgtagtgatgacgagcataactggtatttttaagtatgtacaatgtctggaacacgttataaaagtatctgtcatttctattagtgacaaagtcatgggtatctctattgctggagtttgttgctcacattttaactgaaaaaactgcttacttttggttttaattgaatacaaataaagataaagttttcccccaatccaagttcacagaccttatttctatccacataccctagactaaaatctcctaagagaataccactatttcctaagaggtgatttataaaacatgaaaacaatcacatttaacatgaaaaaagatagagagtagtgatggaaaaagtgatcttagtacaaaggtttactacctgccctgcataaagcccctttcctggtacatggcacggctgacagacaatgtggccactcggcattccactgagtctgtgcctggttctttccctgcctgtctagttagccagctgtgggacattcacagagagctgagccagagcccaacagaccctttttctcctttctcaataaggttaacagatacagagactgtgattggcactcgagttgaaaagctatttgcgagtggagctgatgtcttaatcacagaaagccaaagcaaaacaaaatcattgagaaacagcaataacaggaaagtggagaaagtccagatacaaataatcaattaataaacacacaaggagcagctctgtaatgccagcctacatctaatttcttaagaaaaaaattacagtacaagagtaagaaattaggtataggctggcctcatagagtcactctcaacatgtcttttctatctttataatatacctaagtagtcctgtggctgtctttctgccacgccataaggtcctggtccactcgaaatcacttctcatactttctgttttggttttgcctttggcatcggataaacaggagaaataaatgaggaaacaatgtataaaaatttttatgcaagacaaaaacactgtttcttcaattctaagatatggttttatgtcacattttttcaataaaaacatgcctgaaattaaggtacttaatgccagatgaactcgacagctatcatgcatggggttcttcatatgtaggtgctatttgttgcacacaggtgagcttagcaattcataaaagcaatttcttcatttatcaatcgtaagtgttgcctgagctcctattatatgccagttactactgtagcagaatcatatgtaattctcctcaatatattctgggagattattagaagtctctcatttgggtagatacagaccctttagagcttaacttcagagtagacatagactagattttattccttttaatactttgacttcaaccttttgtagtatacaacctctacaaccatagatgttagccattgttactaggctctgtgggataaaacggtagagaagtccccatccttcaaaaacttatatccaagtatgagtttgtcaaagagatggacatatacgcaaatgagaattatctactttctatattccagtctactggcatctcgctgtagttgatttattcacaaaggtaacccttcacaaagttgaagcttaatttatatttggattactaattatctcttaataagtcttcataaagatgacactatattttagcatcaatgtaaaaagttattgtgtacatagattttgtttcttacatgacaagcaatgcaattaaaggcaatggaattttccaaaactcagaagagatcacaaaagttttgaacttaggggataatgttgcaggtagttcctgggtcacagaaaccattatgtgtcaacatctggccaaattcctccagctaatttaaacaatgtccagtgatgttcagttgatgggaacaaaataggaaatgtggactaatttctagtgccttcttaagttccacaaaattataaattaaaactaaaagatgttcaatttatcaccattatcaacttgtatttgaaaaaagcagtgatatgatggtggtttataactgctaatggtcaaaagtgattcacaggacaatttacactctgtaaaaaaagagacctagagttaaacttttatgtatgctattcaacaataaggaaccagtattcaatcatttgtatacatgctgttttgggttaggaaaaaatattgtgttaatttagtaggccttaaatttttccctcaaatgtgtttttaatcaaagatatgacttaagaaataagacttaaataagacttagcctttaaatactatgctgagcttgctttctggagatctgaaatactaattgaccaatgtatatcaggtgcctaatatccagtctgtactgtgctattcactgccagagatgaggaatgaggtaatctttgcaaacctcactctaatcatgcctacagtgtagctgcagaggaaagcttaaatgcaataaaacaatttgatatcatactagaaaaaaatcacatttttttttggaaacagatgagccatggctggaataagcatgaatgactacaagggaaaggtgacacttgaaggcggagtgtgcatgggatggtttggattgactaaagacaaagtacgaagcaacgagaaggtatgaaagttagaatacaaggctgccatagaggaacagggaattcttactgtaaactaaaagaatacatttgatgaggttgttgacgaaccattttctctggctctaatagtttcccacaacacaagaatgtctgcatcttcagatgtatggagaaccaacctagagctattgccttggccattgtctttatacctgtactcattcctctcaaagggagctccttatttatagggttggcgagatggaaagaaacagctgaaaagatatggcatttcctccttttcaaaagcatccgattctcagcatacatgccttcttctgccttgtgaggtgagaagtggagagggttctagaagatctactcttctgaaggagcaagttcaaattcaatgactaaattcactaaattataactcagacactttaggtttttcagtcatgtagtaatgtgattgctgctaggatcgattttagggctgaagaaaaagcaagattgtgtacactcagttttaacttgacctatgacatgattgtaagtccaccttcaggagattcaagagaaggtgaacgcaaactatatacttggcactaagggtttttatgatagaggggaaaatatctgacataagtaaaatccaattaaactataaattctcacaatgtctaacatattattttccatatgttactttgtaacatttgatagctccagtataaatagtccaaatactaagcactaacttccatgatttcaaacaaatttgctgtctacttcttagccataatttgtaaatgctactctaatttccttattataaaagaatgagtataatgagttaatttcttccagtgaagtcatgccccatgttgatgggaaggatgaagaatacattctgattcattccccatatctacaagtataattgcttgtagaaatttaaaaaggcatgttcggttcagggttcagctatcggctcacttcactgatacagtagcaagatggaaaaaccttctccattggtctctgctgattataccatcagcatttttcattatttttatttaatggtagaacggtaaaaattattggaaaaatcatctggtcctataggaacacctttacaaacatttcccttcaggggtaaagaaatgtagctcacttaacctctattctctcctccacccatttcgtattttcacaagttttccagtaccttccacagattttcttggaatttctcagggacttatattcttaagataacttctctgtctgatctcttttttccaccccctctttttaaacaaattttattatcttaagagtctcctgttctctagagcttatcttcaatcagcaccacatttatttacctacgtaccttaacatcatttccttatagattcctccctttactaggactcaattaaattcagacttattttagctattcctttctcttactcatgttccctgtaatatgaataaaaggctaactaaagcatccataaaaggcatcttgagaagtccccctacccaggtgaattctgcacttagtatttgcaaatattataccatttctgatcacagagaacaggagagggttctttcaccttttagctacgtaacatattcgtggaaagaaaaggaatacattgccatattactgcaattctaagatgtgcatttgtcacattttaaggattcggaaattgagatgtaacatacaattaaggtttaccttgaaagtggtagtgtttttttttttttttttaaattctcagcagctgtaatcatatcaatggtgcatcacacaatctaacatgtcttaaacatgaggaaatgagatgctaattgcttttacagcccccaaaattactctatcatggctagaggtttaggacatattttactattaggctaatgtgacagaataatataatgatacattcaaaaagaacataaagcattaaatagtggattctatagcaatgtgtattgactttttaataacactgtattgtttattaaagaagaatttcatgaaagcagaatgaactgaacagaaataacagctctaactataatgacagtgaatagtgactccaatggcatgtaacagatgttctattttctaagtaacagctgcttgatgcattcattgcaccaagttaatgatctgctagtgttatttcacttcacagataaattactctgctcactttaaaaaaaaaagatacgtaatttttcaggggaatgagagtataacagactttagagtaagtaatagttcttatatttttatagctaagaggaatgatgagttgaggcagttatccagataatctaggaccagaaaccagatctctttaaactgtgaaatcttactgttataaaaaatatatatacaagacatggttgactgagctgaatttaggctctcgtcagacagcttgaaattcgcggatcttgtatcacattatctagtgattctcaactttgctgaataagagagctagttagagttagaccaattaaatcagaatctctggaagtgggccccaaacattgggatacttttcaagtttctcgggtgattttgatgtgcaaccaatgttgaaaaccacaggcaaacagaaagatgcattctgagtttttattgagtgatagtcattaaattctaagagtgaactgaaagccaaaggataattgagcaaccaatgtttgttcttcctgaggttaaatattataaaactttgtttccaaaataaacgtgaaaaacacggtaatttgttaaacaagtggctatttagacatagattattctgcatttaacaccttcagttaaatttattaataccatttgtgtgcgtgtgtgtttgtgtgtgttcctctcaggcaactcttggcatactaagactactgttaataaaacaggcggtaggatgaacatactataggaccaaattttttttttccagaaaatcttattctaccatttgaactttcagatgacaccatggatatttaggggtttaatggaactaaattatttaactgagttggaatctttgatgcttaaaacaaaattagaaataaaatgttagtgattaaatcagaaaatcatatagattagactttgtcaaagcttgtatttcccaaacataatgatcttcagggaagtaaacctctaattaatcacatacatatttactttcctatggttatgttttcgtgatcaattcatatgctaaacaatattggccagtaatgggatgttcagattgatttacttacactcaactaatcagagtgatattaagatactaacaaacaatatttgaaatctaaaatcacaacagtggggacagactacagactgtagtaggtgatagatacacacgggttttcattttattattttaatgaggacttatattttctgcacttgaaatttagccatggtttgtttcatgcttattgtgaataagtagctttttgttattttaagcttagattactttaaaattactagaaaataagacttcttatgataatttggtatagtggaaaaaactgttgaaatcaggcatagtattacagttttgctatgtaccaggacttgtatttgttcatctataaaacgggaacatttgatcaggtgattatttatgtttgttataaaacttgtacaattttaaatgtaaatcagcatttttctcttctctcaagaactgctttgtcattataatttgcaactcttaatttgcaagttacgtttaaacagatatttcatgagtatgtcctatgtgtcaggcaatatcttatgtacatgggaaatatcagagaccaaaatacacattttccctgtccttttgctgaatgaattactattgcctacataacagtccaagagagtaggggttatcatgaaagctcaaggaacttgtgcagttccagtattcaaactcttcaggtgctagtaatctcctgtagattgccttgccatttccttccatcatctctattctacagctatcagtgtttgtcacctcagcctagaaaattccattaacagaaaaggaaaagtatctgaacatttatggggtgataaatatcactgtgatggctgcctcgtggcattgctgttgtctggaccatgcagctagctaggattgatccatatttttaaaaacttaacattaattttaccctctttaatactactctgattgaagggtgaatttaaaaatacagtgaaagggctatgtcgctgtaggaagttgcaattagcattaataatttaaattgtcaattttcatcatcaatcttttatctcatttgttaatattctcaaatggctttcctcctgtcattttaatttaaaaatttttctttaccttttaaacaatttggaatacttttaaaatatattctttttttctgtaactataatttggaaacatggtcacagggtaaggggacacaggacagttttcttacctgcagctgtcccttcagttaatcacccctgaccacatcctcactacttctggaagttctcccattctttctctgtgggatcattaagaattagaatacctaagacattcttgagttcgtaattctcttcaagtagatggtatctttaaacatcttaaattgtgtcacgcaccacccagtatcttttggaagggctatgcattctagtatctatggtttggaatatgttactatttaattctgagcaggaagaaaacttagatgaatcattctatttaggaaagaccaattctacaacgccactggcctatcaaaaggatcccagaaatgtcaaacctctgatactcattcaagaagaagacatggcaaaattctatggtcaaacagggtgctgcttctatattagctttcctctagttcaggagtttgaatatgttctgtgaatggccacatagtagttgttctaggctttgtgagccatgcagtctctgtcacaattactcaactctgctgttttagcacaaaagcagccagaaaaaataaacaaatataaattgatacacttcaatagtcttatgtacagacactgacatatgcatttttaataatttttatgtgtcctgaagtatctagttcttcttttgattttttccaaccatttacataaaaacaattttcagcccatgggctgtacaaaagaaggtggctgaatggattaggcctaccaattatagtttgcccatctctgctctcatttatctgactagttaatttgccttcctcttggtgagagagtctcttaggcattcttctctattaggaagctcaagaagttggctagaattgatatggcccctattaggtcagctcttttcatggttcccatggtaacattaatcctcatattgaggatcctggacccacatgactttgaaatccttaggagtgaatgactattacaaatgtaatcatggtcaccctatgaaagcaatcaacatccgttattttctgactttttaacaaaagccattcagactggtgtgagatggtatcttatttagggtttaattggcatctctctgatgattagtgatattgaagattttttaatatgctcattggccgcttgtatgtcttctttcgaggagtgtctattcacgttctttgtcctgtttttaatctgtttttttttaatttcttgttgacaagtttaagttccttatagattctggatattattcttttgtcagatgcaaagtttgcaaatattttctcccattcaggaggttatctgtttactgtgttgattgtttctttttctgtacagaagctttaatttaattaactctcatttgtcaatttttgtttttgttgcatttgtcattgaggtcttggtcataaattctttgcctaagccagtgtccagaagaacttttcctaggttttattctaggatttttagtagtttcagggcttacatttaagactttaatccatcttgagttaatttttgtatatggtgaaaggtaggggtccaggttcattcctctatatatggctagccagctatcctagcaatatttaatgaataaggtgtcccttctctgttgcttatttttgccaactttgtcaaaaatcagttggttgtaggtgtgcagctttatttctgagttctctattctgttccattgatctaggtgtctatatctgtaatagtattatgctgtttgcgttactacagctttgtagtatattttaagtggggcaatgtaatgccctcaactttgttcttttggcttaggattgctttagctgttcaggccctttcttggttccatatgaattttagaattgttacacaatacacccatgtaacaaacttgcacatgtaacccctgaatctaaagtaattttaaaaagaaagtaatcgagaaacagagaaagggatatggagctttttgcacagttttcttgtttacaaaaagggaaataagatcattttcagaggaccttcagttctgatgttacctcacccagtgacttacagatctgtcctctctaataacgattctctctgaatagaagtgttcttaaggatagaacagcactgctgccacacaaactgaccatacacaggctaacttttggttccactttgatgaaaattctcagttctcggtttgcgctattcattcccttgactctgctttcacaaggaaatcattgataagaatctgtcgatcatgcttcaatgtagataataaagaaaaaaaaagccacagaaacatcctctttaaaaactggaaagacaatgttccttattcatctcgctggaattaatctgctaggttcctgtcctgttgctcaatcagcaggagaatctttggccaatgcttaggcaaaccgaatgaacagtggccatgctcttttgaaaccaataatactcacgaagtgggtgttccttaattactaagcgttatcttacagaacctggctagtggagtttccaaaaggaaaaatcccaagcatttgcttttgtatgttttcttatgttcttatatgtgattttagacacacagaaagtataccaaatgtaatcattacttctgtatgcataactcatcttaaggaatgaaatattacaagtatcatttaagtgtcctgttcatatcccacccaattcttttgtctttcctcacagagatagctcttgttctgtattcagtttatattaattcccaaacatctttctgcttttactatatattatatataactaaataatgtatatttctacatattttatcctttgtgtaaatggtaacacactgcaacatttaaggtgtttccaattttactatatttctcaagaagcttgatttttataacatctctttcatcgttttaggcaaccttccccttcctttttaaagggcacagcattagaaaacaaatggtgaattgccccctaagcctatgccaagtttataaagaacataactgatcttttggccagtgtaagaaactcttctggccgggtgtggtgactcacacctgtaatcccagcactttgggaggccgaggcaggtggatgacctgaggtcaggagttcgagaccagcctgaccatcatggtgaaactccaactctaccgaaaacacaaaaaattagcagggtatggtggcaggtgtctgtaatcccagctacccgggaggctggggcaggagaactgcttgaacccaggaggttgcagtgagccgagatcgggccattgcactccaggatcggtgacaagagcaagactccatctcaaaataaataaataagaataaactctttctttcggtatctatttggtttccctacaagttggaataattcatctcaatgctagtagtacctctctgaaggtgcatggggctgacttaagtattgctcacacaatgatggttgtctcattttattaattctgtgtattttatggtaggcctaaatgatagttgtgatgggaccttattgagaattttggtggtactggaaaactgcttgcacatggactatggccctataaataggcgatgaaatactattaaattaattaaataacataatctagtaagaaatgaaggaacagcaagaatgcctggctgctttggtggtcaccaacatagtttatattatagacaatgcatcatctggggcctgcccacagccacggtaaggaggtgaaatgagtatagagaatccaattttttttttttctcataaaaacttaagtgttagatcattgtggaagggcttgatttgatatgacagggatttttgataaaccgcattggtgacatgaatacagtaagccagaccagattgcttttgattttaatgttagattcatttttctcagcttcgtaatgtaagaaaaactgaattgaactttaaatatgcttatacttttctaatttaggataggaaatttcctcgattatataacacggctagttaaaaaccaaaaccctaaaacttttgtgtcacatgaagactttatgaaatatatattactatagattagtaaaatctgtattgtttttaaggtgacttctgattctccaattggagcaatacttccaaattctttgctaattttgatcttgaaaagtgaattctagttttctcatatcacaggaaaaactagtacatttagactcagtattatcattaaccagtatattaattttcatcacactcagtacttgatacttcatgccccctataaaacattctcacttcaccttttaaatgccatcatcaagtaagagagtactactgagctttattttcaatagcttttacagctaaagtaatagcccaactgtgttttcaaataaatacattcactgagagattgatacaggttcctagagaagtcaacatattttgagttgtcgatggtgagttttctttcttcaattatgcttggcacgaaaaggctcaatagccaatttctctgtgactggttcaaacccaaaactctatgttagcaaaaatttttagctattgaagccttctagtactatgacatacacatgaatatgaagccctgctttccaattagatatagggccaagtatagaaatgtgttctcagttagaaacaatctggcttctttccaggaaaaagatacagaaaatttttttctgtattcagagaaaataaataaccttcaaatctctgatgtctaattctacttaaaagctcagttgcaggaaagcatattcacagaaggttacatgatgtgacaattacgtattgcatgcctgtataaaaatgtctcctataattcataaatatatacacccagtatgtatccatacaaaattaaaaattaataaaatagagaatctgaaaatctgaaaacaattgctagactactttagacttctgctccaatattttttcctctcatagaattgcttttcctgaatggccctttagcactaaatttttctttttcatggagccatgttggtagaaaaaaataaacattcttattgtttattataagaatatgaatcagcgtgttatcacctttatgaccctcccatttattttcttctggcactaagttctagcaaaaagctaacatactactagtaaagttaaaattattttaattattattttaataatttggaaactttgggtctcaaaaatatgtttacttcttggttttgtcttttaggaagcttggcgccaatttgtggctttaaaatgttccctgtccattccaccacccatgatacattgtggatatatttctatgcaagaattttttattatttatctactataattttccttttcctagttttccaatttatttaggcttctcaagttgtgccatatgtatctcttcaagccacactaaataatttttctggaatttaatatatattaaatataattaagatactttaagataaaactgatactatttaactatagtcaatgtacttgaaattatgctttgtttggataaactaaaggtcaaaaaatcacttcatgagtaattgacatttttatgtatttgaatatttgaaactagatgttcaaatactttcatacgaaaataaatataatgttcttgggtcaacagaactgggagaaattcagcagatataaattaaattgtctaaaaattttttaaaataataaaaaagaaattgactctagatattcaaatttgctgcagtcacattccaaatacttggaatgatcggcaactacatttaatgtattgcatttaaatgaatttaatttagtttttaaaaatgtgacatttatcttttgaaacagcagatgaaacttatagcttgaattaagctctccacctaccaagaaaccatgagaaatgagaatgtactcaatagtcacggggtttcatatatgagagtttgaattttatgttaaaatattagaatgattatcataaatgtgactggcttagatctgcagggcatatattcttttatgattgttatttttaaagaaataatgagaaccttccaaataaattggtaaaaaaaaaaaaaagttctgtaattcagatgcaaatgaatatactttatttgacaactaagagattttagagtatgtcattaacagcttagtgtttgaaaagatctagatagagtgataaattatctttattctataaagaaagaaaataaatgccagttttctaagctttttttttttcctactagatctcacagtagctttgctccttgacgttatgaaaaatactttccaggcagattcaacaagcagacaattctccagactattcaagccttctatatgagaaggataacctagaaacctctgcaaaggtcattaccttataacatttgaatgatttcatggtgaggctaatgcaaaaatacctcaagtaatatgtttgaatgataagaaaaaataaggctaatgtgagttttaacctgtatatactgtatcttccttgctatagtaatctcatgtatgatcctgaataactataattcaatatcttatctaacattacatttattctgaaagagaagaaaaacaatttaattccctactatttatttggaaatattttatgtaacaaaatatattactacttgttctctgaatctacataaagacagttttcagtttgggtctcatttatacgattgtaagtttttacataaggtattgaaaatttcccaactttgaataatctggatagccacattgaattaaaaataaagtataaacgtcttatacatctagttaatttggtaactttaaaacattaagtgggtgtaaatggcctaacacagtggcaaattttgaggtaaaacatgttatcaatatcagctattttctttatatcaacacactttcaggtaatctggtaatgaataaacagtaaaaaaaaaaatactaagctatgagtctcttgactaagttctaagcagcatgaaatgattggccatcagagaaagggcaagaatttaacggctaatgattacaggagtcgctgtgtcatttggtgatggaaatgatagcccctgcatagacaccttgagattctttctgaaatgcgactttggcaatatgctaatcttgcaagtcctgtccagcccaactgtcttcaatctctgtgtccttgccctcttcatggctgtgggattcatctgggcagtatggtcttaggcaagccagtacattataggatctcatctctggaccaattttcagactaatgacctatgtatttcttaaggtcttattcataatttactgaactctaaggaagcttttggagagactcctgctaaagcttaccattggttttatcatggtcctgaaaagcacagattaatttttaagaaagggaatatgaaacaatattaatatttataatgctattattgctacatgttaatacttccttacaaaatcatattatgtgttttcacgtatgttcaaaataaccttcagtgatataggttttacctttccccaggcaacttcagaatccaaattactaggcattccttcaactgctgatctctttgtcaattccatatctgtagctgccagccattctgtcaagacattcatttcctttcgcatcttacgggacaatttcaagcatttctccaactgttgctttctttctgttacctgaaaagaattataatgaaatgtaatttagtttactctttaattcaaatttcgttataaccacttatttggaacttttatatttctgttatttaaaataactattttcttacacgttttaaaataatattttataaaaatcatatattctgaatattaagagtgaataaaaactgtctagggcagatgacatcgtttgtccaaaagatagggtcttgtatgtcgtcatggtagaaaagaaacctatacgaatttttctctaagataatttatagccaaagtttatgataaatacaatgatataagtcaaactgaagataaaactcatttctcactgaaaacttactgtcatgtgtcaataatatggcaagaaggtttacaatcctctatatacaagtgagactagctcatgctggtaaggaatcaaaatgaagatagaagattaattctctcaaaaggtaaaagtatttgtgtaatacctagaattctcaactgtatcctcgttacatctttaaagtgtctcacatctgctcaaaaacaatacagtgaataggtcacttcctccttaaacataattttgccatccaatagggacaaaaagatgaatgtgaagacaatattcattcccattaatagaaaaactaattacttgatcctgtgctcctgttctcagtgtttgataccaacaccctcaaaagcaaattatccatattctcacataagaaatgaacaaatctgtatttctccaccaccttctcagatgtgcctatattttgttaagattttcagttggttggtttaataaaaatcccagcatctctttctactaaaggcagtcaaatcatcaacaaaagccagataaattacaatttcttaaaggcaaatcttcttgcctcacacatctttagattactcctctctactcctgaaagttccttgaacaaagaaaggtctcactaaatatgctttatgtattgaataaaggaatgaatgaagacttgcaaatcgttaattacaagttagaaaatataactggtagaatttacataaagagtttatactcttacaagttgctcctggttttcttttctttggtatgtgttttcacctttttttaaaaaaaacccttgtctgtcatgaagcctgggaatctgaacaatagatataaatatttggctctgcagaaacagcatgatggaatgtaagtatgttaggctctgcgatacgtagtggactctcgacttgagtatgatttttggcagaacacctcatttttctcaacacatctgtcaaatgggattactatacttattaatagaacacaggaatattgcgagggtaaaggcagacaacagtttgagagagcatgacatattgtaccacctcaatcccttcctttattctcattatttacctttagggatggttcaataaaaaactgtgcctgaatgtatagagcaaaagctttatttacatttattttactaccttacaggtaaataaaacatggacaagatttggcttttgttgctaagaaatctgaaaggtagactccagattaatttcaattgtaatggaattggttaaaacaataccaccaccacaagtgcgttatttgtgcattatgccctaagcccaataggcaccactgactgatacatatatttatgtcatatatatgtgtgtgtgtgtctatgtgtatgtgtgtgtacaaccaaaataagaatctatctataagcaagaaaaacacaaaagataaaaatatgtataaagcatctaaaatgctacaatcgaaataaatattctggaaccttgataacaattccaattccaaataataaaattccttattttctttaggagaggtgtgcgtacatttagaaaacatttagttgctgaggctgtaaattcattttttaaacagattttcccttctatttttttttttcctaagtaaaagcatctgcccttttgactgcaagaattttgtgttgtaggggtgtgtggggggtgagggaaaatatactttatggtgtgtttctatgcatatttttcctatgcattattggtagaaaaatgattccagattcaatatttcaaagaaattctatcttcccagagctaatgcagtattgatttttatttatttcattttgtttatttccagctaaatacatttttaaaaaacaggagacactgccatcttaaggaaaattgagttttatactttgtgtgtgtatgcgaggaatggatacgtttaacacaatgccacctgcagtaaaatgttttagtagtcattgtttcacgaagttaacaatgtatttaagggatgatattagtattgctatttatgtaaatttccataaaaatcagagcatagagaaataaaaaggggttataggtattattacatcaatggtgccagctttaatatctcttaataaattaattatattttctctccccactcatcaccatgtaagaatacagcaaaaaggtaagacaagaagaaagctctcctcaggaatgaaatggatcagcaccttgatcttgcactcccagactccacacttgcagaaatcaatttacctagtttattttattgtgttatggcagccagagctgattactccaaaaaggtaatgcatactcaattgtggcagacacaaccatataaattctgaagatggttaaaatagaagggttccttcttacataaaaagaataatgtaataacatttcctttgttgcctttgctttcattagacaaagctactgctgttgaaaatattttgagtcaaaatccagacaatatttttattctcaggcaaagaatataggacttacagcatttttataagatggtatttatacatgatcccttagtcacaaatgtttctacatcaatatttacttcaaaaataaatgtttggcctatgtttttgctgtattctgtgatactattaaagttaaatatgatttcttcatacacttttattttgctttaaggatattactatgtggcaaatggttagaataaacacaagctctcagatatgtattttcaggaataaatagggtttgacatcattacgagaatcattcatttctgaataataatcaactcagggcactattattcgtctaatgtcactttcattgctttaaattctaattgatttattctgttattttatgttaaatttactcttgcaatgatttcgtaaaaattcctatgacaaataaaaagcccacacacaaaaaacctctattttaaaaagtaaactgagaaactcccctttaccaaaacatatattttcttaatttaaaaaatactcatccatacattattttagtataaagtcacacaggtcaaattataaactgaaaatttgtaatttataactataacatacattcattttattaatttaaaatttataattacaaaaacaatatatctccagaactgaagctgtagcattaggattaatattagagattattcaatctctaatacatttgagactagagattactcagtccttcgtaattgatgttaaatatgaaataattggcatctataaaaattgataagcaccggaataaggtatcaagtgcagatacaatttttctgtctgtggtgatctttaaacaatgataaatttctctagaggatataaaggtatctcattccaaaggtaccttggtagaccaaatgaacagttgaaatgtattttatttcaagattatcataatgctttcccatcaattgagtatcagtgtttcttattttgaaacaaagtaggagaatcttttgtcataggatggcaacaaacttgtttaaaacataacaaatattaattagagggtttttaaaatataaaaacaagactatctaagaaaaatgattacttccagatttcaacttaattataaaatttactttctatggtaaggaattggcaactaatatcttgaagatataaccttcaatctactttcaggctgagatgcaagaaatatgcctctccttagctatttctcaaacatggacattcatatttctgtctaagatgaggtgacaattttatcagtgatgttgttctattcactaaagttgagaacctgagttgtaaaaatataactttttatcctccaagaaattcagttctttcagtcagaacgaaattaaaatgttagaagtccatttttggaaatactaagatatccgtttatggaaagatatcccatattcatggattggaataaataatattgttaagatgtctgtaccactcaaagcaatttacagacttaatgcaatccctattaaaattccagtgacatttttggcagatgtagaagaaagaatcccaaatttcattttgaacaacaaaagacccagaatagccaaagcaatcttaagccaaaagaacgaagctggaggtatcataattacctgattcaaaaatattctataatgctctagtaattaaaagagcaggatggtagtataaaaacagacatatagaccaaaggaacagaatagagagcccaataataaatccacatatttatgatcaactgatcaaccaaggggccgagaatacacaatgaaaaaaggacattctcttcaataaatggttctgagaaattggatatccaaatgcatgaaaatgcaattggacacttatctcacagcatataaaaaaccagttcaaaatggactcaagacttaaaacctgaacctataaaatgatttgaagaaaacaggaaaaagcttcctgacattgttctgggcaaacattttttttggatctgactcccaaagcacaggcaacaagaggaaaactagacgactgttatcgcatcaacctaaaaagcttctgctcagcaaaacaaacaatcaacagagtgaagagactacttactatcataatctatacagaatatttgagttgagcgaagtgagatggagagatataggcatcttgaattagcagtgaagtggagctggtcatgagactctgatcaggacaatgatacaaaaataattacagagacgtaggtcttaactggctatccatgctatcttattagccaagtgtggtagattttgcaagtcttggccatatagggaaataattactgtgtaatttttaaacttaatgtggtctctgtggaatatgttaacaacattagacctacatataaatagatacagtttataatatttaccagtcttcaagtcatcacaagtagatatatataatgaaaataaggaacacttacaactaagaaacccttttagagctatctgatggaccaggaaaaacctccctgagcgttacgtatttttcaatctgaataagcagagcctcactgattaattattgtttcttaatgagaattccacatcgaaatatgtgtatatgtttatctttgtgtatatgtgtacatatatatatatacgtatatgtgtgtatatatatacgtatacatatacatagagagagagaggtgtttagaattgctaagactctaatcatacataatttattgcccgttgctttacaatttataaggaaagtggaaagaagtgtttgtggtctcagcatgcacacacctttgctcccagctcattataatgcaatttcaaagctgttactctttcatcaagttctttgggattttccgtctgctttttctgtacaatctgacgtccagtctttatcaccatttccacttcagacttcacttcactcagacttttatacaagttctaagtttaaacataaaacaaaacatgataatcagtagagttaaattatttcataatattatgaacagaaataaatagagatccccttaattgctattccatgtttgaaattttaatagagtagcattttgcagcggtggtcaatatctagcttttgcattttctgttgatttaatatttctaattgtctacacacatgcatatatgtgtcatttgcagctattcttattaaacagagagttaatcatatatatgtgttttgtgatatatatatatttagttcttcaatcaaagaacataaatgtcaattctgaattttacatgacttctattttaaatgttggagttatataattctagccataaatttggatgaattaattcactcctacatcgggtatttattgagtggttactatcaatcagatagtatttgaatcactgggaagtcagtggtggccaaaacacacacattcactattgttctcatggtacttacatattagtaacattaaagcacctaaatttctacatcataatttcaatatatattgtatcatatataagaaagtaaggtccttttcaatgttaattaaattacacaactttattttcttaaaagtgctgatgaaaaccagatataaaaatattattgacaattcacatgtacatcacaaatataaagcacacacatacggtttcacaaaacataggttgctataaaaaagcatcataagacaagtgtcataactttggaagacagctatgttcacaattataccaccaacaccactccaacaccacttgatgtcttaattttgctttgtagttttcctagaaatatatgtctttgtatgtatgtggccatgtattcaaatatatgtacgtgtgtgtatatacgtatacacgtatatataatagtttacattatgtatctctgctttaatttgtttagtcataaatctgaactatcagtacttattttagtattaccaaaaaataaacctgacagtaggtaattgtttttatggaattagaacaaaaattgggtttaatttctcttttcagtttaaaagtaatgtctaaaaaaaagcattttgtaaaggctggacaattatctgatcaatgctacatgtatatttccatattaatcctctttgacaaatgatgttaacattccttcatcactaataattatgacttttgtctgagtttcccagatgatattatttacttcattttacttttttcttagaagatataaaaatatctgtgtatctggaaacactgaaattaattattatgttggaaatcaacgatgctaatttggaatcagagatttttctaaattatttactctctgaacttcaaaaaatataaatgctttattttgatgaagaaagttccctcaaggtaccgttagccattaacattgtttcattcaataggcaagtaaaatatttataaacaaaggggagaaatattatttatatttgtgttcatgaaagtaagacttttataaatagacaaacatgtcttgaaggcaagactatgattatggtatacaccacaaagcatcgtaaacaatgaaaaaactaaacagtgtaaggatattcttatgaaagaactgcttcaattggtcctgacatttaaaccagaaccagaaaccaattgagcaaatgccttgagcagtttcctttgtactgacgcagggcacagtcacagcttgacacaggtgagattgttttcagctcatatttactgttggatacattttataaggtaacattagagacctgtttctagaaaagaacgaaaagtgctcactttgcaaatattagtcatgaataaggcacttgggtcatttatgctttccttttttttttttttggcaaaatttaagatgggatatgttcccatatattcctatccttactcatctaatatcaactaactactttctatcatttctattccaagtttctttttgggggtgagaataattaaagtaattataccactaaaatgcagcttgaattatgaaaatatattatcgaataagaatacctcatatttttcacacataaatatatgtatttattttaagatatttgttaaaaagaaaaatatttccccattcatgatatgactacgatgtatctgaaggactctgtttttcattgatattatggagtagatgtagaaacaatacttaaaatatcaagtactaaatagacttgttttccctttaataacattctgtgttttcattttatgtgacttcccactctaatggccgatagtacatgtagagttataataatacttatgttactcgagtagatgcaatcatacctcagctttgttttcagaggaatcatctcagttggtgagtttccaataacagcaacataggacaccgttcaatattataaagtttaaatcagatttatactttaggctatttgtacctttccatgccttttaattcggtgttgtcttgaggcatttcactgtatatccagtactggtgtttaaaggaaagttattaaagtttggaataagagtacctgaattggaatcttgctttgccattcaccagctgtttgtccttaaattctctcaggtaatctgtagccttaagaattaaaggtgacttctgtatgtcacgtagtttacctggcatccattatttctgaagttgttaggattattgcaactactgttgttgttactatttttagattaatatatttcctttctagatttccatttaaaatatatttaaagaatcataaaaattaaacacaagcaacatccttttatattctgcacagttcttagcagaattatagactcaaaaaagacacacagaataggccacaatacatgtgccaatttttgttctcaatcttaaaattacatagtataattattatggttatctgaaaacaattctctcttataaaagagcagttacttcttaatgaggaaagtcaaggggtacctgcgtatttgccaccagaaatacataccacacaatgatttagctgtgactgtactacttcctgttccacactctttgtttccaatgcaggcaagtgcatcttcacttcatctaaaatcatcttactttcttgtagacgctgctcaaaattggctggtttctggaataatcgaaacttcatggagacatcttgtaattttttctgtaaggacagtgtaaaaaggcactgatttaattttgcctttcaaacaataactggtcctatttttattgatagatctgcctttatttctgaagatatacagaaaaataaaaacaaaataaagcagtatttttccattcatccaacacaggaaaacatacatttgggagaatgattcagtagttttttcttaatgttatactaaataaaaggtaatttattaacctattttatctttaaaatgtagagagcaaaacactcattgtttagacatcaaattatagttttcaaataatgtcctcaaatccaatcttgccaataatcaagttgtccaatatagactggagtataatgcccaacgaaaacacgttccttagtttctgaaataacatatacctgtgcaacatcaatctgagacaggactctttgggcagcctccttcccctgattatgtttcttcatttcttctaaactgatctcatgacttgtcaaatcagattggattttctgttgggaggatagcattattagtcagcatgctctacaaagaacaactaactttccaagaagacgaaattcagaaactctcctcaaccacctctaccatgtagcttcctttaaaatgaccgtaaattggccaagagtggtggttcacacctgtaatcctagcactttgggaggtcgaggcaggtggatcacctaaatagaattatcataaatattttttactttcataaattatccaagtgaaacgatttatttcttccctatgggattattatgaaaaaagcaataatcattttgagtcaatatcaactatttcagatatcattttcaataggtaatttatatattatatgtagaattgatatgttttatctttgaagtcacactcaaatcggaccaaagacatgatgttaatctgtaagattcagccaactgtgacagggatgagatataatgagaaaattgcatgtggaaaatactccttaattaccttctttttattttattttattttattttgtagaggcagagtcttgctatgtgacccagcctggtcccaaactcctggtcttaagcaattctcctgtctcagcctcccacagagctgtgattataggcgtgagccactgtgcctggccttagtgtagtctactcagtcattatgtgccatatttcagttaaatttcagggaagctatgaatctaagaaatggaagtcaaatgccccaaacaggtattgctatttgtctgatagatatttgatggcttccggcagatactgattgtgaattttagataactataaaacatttcaatatttatatattcaataaagacattttcgatcaagttctatagtaaagtatattctgcatttaacatatgaatttctgagccagttataggcagggatctctgcagcatgtggacacgaacacaatacatttatttatttatttctgtcaaatccatacaaaatcagctagcggtcaaatcattctaatttaaaattcagtcattattagattattataatttagagcagaaactaaattataccagagtgcccataacattatcatgcagatcattttgcataacgtatattagtgtaagtgaatttacaccaattggagtaaattctgatacatatcattagaagataacatcagttttgcttagcagtttccagagcgaactatagccctgaactgagtaatgagaattataccaagaacatggactaagtggttaaggagctccttatgcaaggttataaattcacagatgtacctcaatattattccttagaatattaatcctaacaattatagaggcaaatcaattatgaattacctaaatagttagaattctgccttaaaacaaatgagagcaaatacgcatataaatgtatcttattttattaccatatcgatgatcttcattggttgaataactaccttgtgtgagaaatattgatatgtttcgtgaacctagaatctgggagtagggatccatctaggtgcatgacgttatttatagagcaagaaacatcacagaatctataaaattggatggaagtatgcagggtggagtgatgcttgtacggaggatgtcataagggagttgatgttaaagtagaactttcaataattagtaagcattgctgggagtaacagatgctttagaggggttatggctagggcctttcatcttggaaatgttaatcctcctcaaaaaggtgggccagtaacaaccatgtctgtgccacgtaattctggccaactccatgttatgggtgatcagaatacacacaatgcttgtgttaagagagaatcatcagaatctctctcagaaaattagaattgacagaagagtctggtcaaactgtgagtgcttcgaattgtgtcacatatactagcaaattgtgcttacgaagtccctagtttgcagagtggattgaggaagagcaaaggtccatgaacagagagagaagaaagaagtagatgcatagggagtgaggtggtaacaaaaacactgatggcttccaatgcggtatggctttatttatttatttagttagttatttatgttttgagatggaatctcgctctgtcacccaggctggaacgcaatagcacgatcttggctcactgcaacctccgcctcccaggttcaagcgattctcctgcctcagccaaccaagtagctgcgattacaggtgcccaccaccatgctcagctaatttttatattttttagtagcgacagggttttaccatgttggtcaggatggtctcgaatgcctgacctcaggtgatccacctgcctcggcttcccaaagtgctgggattacaggtgtgagccaccgtgcccagcccgtagatagcattttcgaaagagggctgcaataatagctcccacagcacatgctcctcttaccactccctcaacaagaggtgaagtttatttcttcagctctttaaatctgggttgactctttgactgctttgaccaatagaatatagtccaagtgccagttatggcaaaagtccttaagtggcctggcagcttccacgtctatctttttagaacagtcattcttagggtgctcccttttagaatccatccaacatattatgctctgagaaagctaagtaacatcgaaaggccatggataagtgcttcagcaacaatcacaacaaggctttcagccaacaactgctaggcatgtgaatgagtgatcttggacgttcagcccagttgagcattcaggttactatagtatcagacaacaatggactaaaatcacataagaaaccacaaaagagaaccatccaggtgagctttctcaacacgcaaaaccattagtgggaataataaatggctatcataaataaccaaaacacaggcattagtcccttcttgagtcaaaactttattactgcccttggattctatgacacattcctgtttccatatgaaaaacctttctctctcatttgttttgctttagttacttcaattttgttacttctaaatgagagtcctaaatactgtatatgcatactggatacgcaaggatataggagttgtaaaaacaaaagcatttctggttgaagagagacaaggtgtggagacagggcactgaagagcataaggagtttggcaaaatttaacaagaaatgtaggtagaaatcaggtattaaataactttatgtcccaaatgaatggttaccactattttgatcacgaagataaatttcaaaatttgaaattgatcataatcacagataacagtagttttattgctaatatttgatccgataactaaggaaattcatagggaggaaatgcgactgtaaatcagcagtatgttgaagtgagtttgcattttaataatcactatgtgtgtctgtacagagagaaagagggaaacagggtacatttgtataatatgtattttttcagtgttttcaagcgttagaggaaagcagaaagagagaacaaagagagaaccatggagaacacaaatttaactgacatggaaagaaaagcaccaaataaagagaaagaacagtcaaagagaaagaaaagaagaactagaaaagagagaaaatctcacatcaattgatgtgagaattttaagaatgagagagagaggtcaacagtgacagtttgagataggttcaatgggatcaatagtaatcagggtacatgagctcgtcaatgaccattgcagctagaagagagaagtggatgacgagagcagaaatcgtattttcaagggctggcctgattaaggatcaaggagcactctaataaaaatagtttaaattacttttgcagacttttgtctccacacataataaaattcaggtcaatcagacttgaacatactttaaggctacatgaaagaagccaacacataaagtgattttttttaaatgtaagaagataaacttgattttaaaaaaacctgtttaaagcaagaaaaccagagtgaagcacaaagctcagggccaacggaaaatatcaacaggaggagaggtggctctttttcagaaaacaaaagtaagatgtgaagacgcaagaagttgaatgcttcctacatggtgctctcagagtatcagggtgaaatcatgttaacagtaaccaggatttaaatttcagggctctctcttgccaccttgggcaaagcatcaacatgttctgaaccttgattttctcatgtctagcccaagaatgataatagcaagccagcaatgaagttttcttatctgagaaattctcatttcttcagtagtcaactacattggttttggtcaaaaagatcagatgtgacagtatatgtaaaaatacctgtccatgttatttgcacaaatatttagttataagttatcagcgatataacatgtcatttcctcgtaagcacaaaaccctaggtatctgctgaggatgagaggagagaatcaaggtggaatttaaatcaaagtgataaaagttcaatagcaattgtggagactgtgaaaggaaactgatttaaaaaaataagaatacactcagagagggtagagggcccaaattatacatctgtaatcatatctgtgtacatgtatttaaaagtttttccatccccttagcctccaaggttagtagaggaaaaaatgaagtatacacatagtcctttaaccttttataccagagtggtcaaagaagagcaaaaaacaaaaaaacaaaaaaaaaaaaaaaaagaaaagaaatcatcatcagtatcctcaccaccacagatatttgtgggaacttatgtgctaacactttatataattaattccatctcctaatcatattaacataagtatttatcatcttcatgtacaaatgaaggtagaaacatcaacatgcccaaggtaacataactaggaagtaacaaacttgctgccctctaacaattatactgcctctttaattatgattttaaaataaaagtatcctccaaatggacatttgtgagaaaaaaagaaatttaatcttattcgtatgttgatagcatttagtcaatttaattcaacaaatcgttcagcttctactactcaattccacacagtgagaacaaaattgttgcccctatacttacagaagccttattttaagaggcagactgtagatatataagtaaattacaaagcagaaatatatgcaatgtaatagaaaaactaacatcacacaccagggcctgtcgtggggtggggggaggggggagggatagcattaggagatatacctaatgtaactgacaagttaatgggtgcagcacaccaacatgtcacatggatacatacgtaacaaacctgcatgttgtgcacacgtaccctagaacttaaagtataatttaaaaaaattttaaaaacagaaaaacccatgctctgtgatcagaaagataaatattaatatctgctgtataatctggtgatttttaggaaatttacatgatttaactagcatatggctgagaaagggttttggagggtcagagaataagaatataggatcttattttaggctgtaggaaacaagctagcaaagattaggcttggggcatgcagagtgtgtgtgcttaatttaatgggaggaaagactgaatgtgagttagtaagaattactatctagatgaggaattagtatgaagctacagaaccttaagtttcagtgcctctcacttgcaagagacccttctataaaccagcatttaattttctatttataattttttttttcaaagactgcccctggaaattctagaagctcagcattacaaagcaaagcaaagatagcgtaagtgatcactgcaacacaggccttcctgataagttccacattttcccaaatgagtcatattgttgtcataagtcataaataataggaacaacaacagcttacatataaccaaacactcgacttttatctgttggcaggggacatgaaggaccaagtaacctgtgagaggaatgttgggcaatttggagctcaaggcaaagcattccatggaatttgaaatatacatatttccattaaatagttagaaaaactgttgaggatgagcttctgtgtttttagaaaggtcgccaccactaaaattattaacattgaaaaaaatcatcattgaacatcatataaaagtgagacttttatcataatgtataggcatttctagtgaaattcgcatatttgtagtactgttccaatatgattagagataaaattttctttatgcattgagtagattatgcattaaaaagaactcagtggttaaacatattttggaaattgaagatgaacatgtgtctataccacagaacttctcagaatatttattaatatatattgtgtatatccaagaatcatacaacactttgtagatgttatccttttgcttttttttgccagagtgcatcatacaagtagatttggaaaaaggctatcaaatatacttaacatattcattaataataattcaattcattactaaaattataaaataaaatgtctttatatttccaattgattctactatgggtaagctgtaaaacatgcatgacacatatttgccagcatctttacacattaattccacaaaatttacatttaaattgtaattaacttttagcttgtacttaggatatcttttaccagctactttacctaacctcgtcagaactgtattctggaaccacataagtaaaaaatgcttagcactttagcgcaggcttattgtgaaatagaaaagtaacttgtacaaataacagaatattattgaaacttctgggaagaacaatctcctatgtaaaaatcactcataaaaaaagacaatgtaatcattttcttttttgacattatgagaatatgatgaaagaaaataaaattgtggaagaaaacattggggatagaagattcaatctgaaggaaaatgatctctctacttgtctactagatttctaagttgtcctaaagatgtgagggatgtataatttgagttatattttcacctaatatatacatctagggggatatggatagtaagcatttgaagaaaacaaataagccaaccacatacaactattcttgtgaaattatcagcctggcttcgtataaaatcagtaaactctaatggaaacaaagtgagaggacatagcaaatcacggatactgatgtgaacactcacatatgctctatgaggtgttctcaatccagtacctttcagaatcactagattttcttcatcaaagtcaagtaatataaagcaaattatatcatctttccattatattaaaaaagacatttgagcttatctcaacattccattataaaaaaggcatttgagcatgcagtaactatgttcacagcactatatattcaaagtaggaaaataaaacaagtgaaatcgaattaaccatttttccattgaatatggtaaagggcaaaattatagaaccaaaaaatcattcaaacattaatcacattttaaatataggactttacagttaactgagcagagagcagggctgtttttaaaatcttgctttacctcatcaaaccattctcatatatatagtaacagaaaatggccagcaaaattatactgcagcaggctaaagtacttaacagaatgaagaaaatgatatcaaataattattggagtttctgtggtgtcaaagaaaggaaaaatttagagaaaataagaaaatattttagtaaaagatattaaaatacttcatgttgagactactgattgatggaggaacgtaccactgttagattagtaattttgaaagagccagtaattttgaaattgctattttcaagaaagggaaatggccacatatcacacgtacttagaaaacgaaagaaacaaaatatatcaaaagatttgggatgatatgtactttccaaagataggaaaatgcaagaaatataattattttcatagaaaaaaaatgttgaaaagtttcaggttatactttataataattcaacaagtaaaaaaagaagaaattcacacagctttgtactactctttttttaaacccccccccccaagtagagttacttagaaaaatattacctttaaattaaattttgtcagctaaagaagttttgacttttatcagaaatatgcaataggccaaaggaaacagtctatttcagtgtctcccctacattgttccttgacatatgagttttgtggtatatcaacatatttctggaggaaaaagtgtctgtggcttcttatcaaatttaggttaaacttttatttttgaaaatacaaaaaagtgggtcaaaaatctccagcagagaagtaaagcatataaatttttctgcgtaatcttgaccacagaaccgtttaaaaataaaaaattggacattgtgtataattattacttgtaatatacctgagaaacgatgttacgcttagtcataataacgacaacgataatagaagagttcattataataatgtattttctaacaaagacattcttcacagaaatagaaaaaacaatcttaaaatttatatggaactgcagcagacccagaatagccaaatatatcctaagcaaaaaagaatgaaactggaggaatcactttacctaactttaaattatactacacagctatagtaaccgaaacagcatggtactggcttaagcgcaaacacacagcccaatagaacagaatagagaacacagagataaatccatacatctacagggacctaatttttgacaaagtgccaagaacacactttggggaaaggagtccttcaataaatggtgctgggaaaattggatatccaaatgcagaataaaaccagacctctatcttgaaccgtatacagaaatcaaatcaaaatggattaaatacttaaatctaagacctcaaattatgaaactaccacaagaaaactttgggagaaacctccagaacattggtctaggcaagaaattcttgaaccataccacacaagcacaggcaaccaaagcaaaaatggacaaatggtaacacaccaagttaaaaatcttcttcacaacaaagcatacaacccacaaagtgaagagacaacccatggaatgggagaaaatatttccaaactacccatctgacaagggatcaataactagaatatataaagagctcaaacaactctataggaaaaaactaataatctgattaaaaatgggcaaaatatctgaatagacttttttttgaaagaagataaatgacaaacgggtatatgaaaagggtctcaatatcactgatcataacagaatagtaaatcaaaaccacagtgagatataatctcacttcaactcaaatggttttatttataaaacaagcaataacaaatgttggcgaggatatggagaaaagggaaccctcatacactgctggtaggaatgtaaactagtacaaccactatggaaaacaagttttgagattcctcaaaaaactgtaaacagagctaccatacaatccagcaatcccactgctgtgtatatacccaaaagaaagaaaatcagtacactgaagaaatatctgtactcccgtgttttattgcggcactgttcacaaaagtcaagatttggaagcaacctaaatgtccattaaaaaacgaatggataaagaaaatatggttttctagatatacaatcatgtcatctgcaaacagggacaatttgacttcctcttttcctgattgaacaccctttatttccttctcctgcctaattgccctggccagaacttccaacactatgttgaataggagtggtgagagagggcatccctgtcttgtgccagttttcaaagggaatgcttccggtttttgcccattcagtatgatattggctgtgggtttgtcatagatagctcttattattttgaaatacgtcccatcaatacctaatttattgagaatttttagcatgaagcgttgttgaattttgtcaaaggctttttctgcatctattgagataatcatgtggtttttgtctttggctctgtttagatgctggattacatttattgatttgcatatattgaaccagccttgcatcccaaggatgaagcccacttgatcatggtggataagctttttgatgtgctgctggattcgttttgcaagtattttattgaggattttttcatcaatgttcatcaaggataatggtctaaaattctcttttttggttgtgtctctgcccggctttggtatcagaatgatgctggcctcataaaatgagttagggaggattccctctttttctatggattggaatagtttcagaaggaatggtatcagttcctccttgtacctctgcagccaaaaaacacatgaaaaaatgctcatcatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactggttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccaccattctcagcaaactatctcaaggacaaaaaaccaaacactgcatgttctcactcataggtgggaattgaacaatgagagcacatggacacaggaaggggaacatcacacaccggggactgttgtggggtggggggaggggggagggatagcattgggagatatacctaatgctagatgacgagttagtgggtgcagcgcaccagcatggcacatgtatacatatgtgactaacctgcacaatgtgcacatgtaccctaaaacttaaagtataataataaaaaaaagaaaatatggtacctatacacaatacagtactattcagccataaaaagaatgacgtcctgtcatttgcaataacatggatggaattgtacgttattacgttaagtgaaataagccagtcacagaaagacaaacatcccatgttctcagttatttgtgggagctaaaaattaagataattgaactatggagatagagagtagaaggatccttactagaggctgggaagggtagtcaggggttggggaggaagtggggatggttaatgggtacaaaaattagaaataatgagcaagacctagtatttgctagaacaggatgaccataataaaaaagtaatttgagtctacattttaaaataaactaaaagagtacaactgaattttttatatcacaaaggatagatgcttaaggtgatagacaccccatttaccctgatttgattgctacgcattgcatgcctgtatcaaaatatctcatgtaacgtttatacatctactacgtgcctacaaacattgaaaatagaaataacgtattttcaagtaattatggttacttttcaaaatagataaatgagtaaatcaaactctagggaacattttggaatgctgcctagaaataattgggagattgtacttctaggttaattttcacttaataaagggctaattattaaagtggagaaagcagatctgagttaaaatatcagcttcagtaaaaatgctttagcattaaaattcattaaatggaatagaatgtaaacaatgggaacattatgatattactatgtaagatcttgcggacatcagtaggccatcaataaatatctaccatttaagttaattccaggttatttaacaacattcatcacatttcaccctttgctatgcatcaaaataatggagtgaaaaagttgatggtaaccttaaattatctttttaaatatataatagtaattgatatattctctattcaatagggttttaaaaacaactttgaggtacaatttacataccataaaattttcattttaaacatatagtcaatgaacaataggaaatttatagagtcatgtatatatcaccacaatccaactttaggacattttttattaacccctaaacctgtgtgtccattttcattcacatcctgttctcaacccatgcctcaaccattcatctagtgttttcaaatattcccttttaaacacaacttttatacttcattaggctgctgtaattaccaaataacgtgaatgctttcaaaatattagatattcacatggtataatccttaaaaactaggtaatacataaagaggctaaaatatatattttccatcagtctttccttttcatgtgaagagttccattttatactattcaaagtattttggaaaggttttcagagcttcaaagttgggcaatcataaggcattatgacaagaagtctttatgatactattaagttccattggaaaaatggttcttcactattatggtaaacgtaagtggccagcaatttctaaattttatctttctttggtgctatctaatgagtggcaagatggcaaggaccacgttaggcttattcacattttaaattttacactgcctatcacatttgtctgacacatacttagtgactaaacctcagtggaattcaataaatttgccagctatttgttagaaatctgctgggtggcccacggtcttacagctgaactttagtggttagagaatgggaatagacggggaaaatttttaaaaagcaaataaaagatttaacaatcacgataaacgctgaaagaaaaataaaacatagtatgttatgctaagtgttatctggctgtgcattttagatcgataaattttctgtgtgctatctttgaagtaaatattcatttgcataagacaaaattgggaaataataggataaatttggatcacttcaaaatattcagagtgttgcaatagtgttcactgtggctgtagcgtgaagttattagactggtgcaaaagtaattgcagtttttgccattaattttaataatttcatccttatatgtagaatttgtagatagatttttacaaaagcatactatagtttaattgcagtcttaaaatgtacacatcaaaataatatgaaagaaatctatatctttatcatatagccagtgaggacataataatgtacaggttgtccaagtacagtcagtgacgtgtggcaagtttctagtattttacatttcctacaacttgtgtttatgactgtttcccacactattaaacatatgaaactaacaagttattcttaaatggagagtaataagttctgtatagcaacacataggggtggcctttcaatgttagaacagattcaaaattaaatgcactaggtttaccatctactgggctgtgtaaaaagaaaataaaaagtctacatctatggctagataggttttaatatttgaacccaaatctctgggttagttctccatttttttcttctttgactaaattatccaattaccacataaattcccctttgcaggtttctgctgtctaactcataaatcaataaagcagactgtaaagttacactgttccaagtcgtttggcaatcaaatatgcctatttacactataagagtctgttttattccttaatgaaatcaaaagctcaatctgatagaccaaaatctgcagttatatctttatttttaagccattgattttgatagcttggaatgttaacatttaaagatgaccgattatatttaatgtgagttataagatttagcttctttgataaacacgggaagattgcaattacgaattcttcttaaagtgcatttaacgtaattagtttaaattaatagctttctttgctttaaaaatcccctcttttctaaattgtactcacattgttaatgggagggaaaaagagaaggaggaagtctggtctgtagtggactctggaacacctgacgtcctagcttggtgagcaaaccacggcagtatttttcaatatttaattatgaggcactcttctttgaaggtaatttgtttccttcctctattcctgctcataaatctactatgtgggacacgaggttacaaaaaaatgagatcagaattctttgggaaaaaacaaatagaacagtaaagctactggagccactgctaagcaactccgctcttgcttgcagtaatttaagcaacagggccatgttttcccctacaaaatgtgcatcaacacataaggacatggtgactttcaacaggtgcccatgttgggttgttcttacatatcaaagattcaaaactaaaattagtagaaaaggaaaaaaatcatgtatgtgaaagtatctttgtaattttaaaaattgcaagacatttaagtagctatttaaacatagttgtcactgtcccctaaaatgattaagagccatatgcaagttaattgacatgttaacaaatggggttagaaaaaaatgaattgaagaaagccaagcagagttcagcctcaaacatctatattgaacattctttttgtctaaattaaaatttgtgcgatagctctcagctatattttcttccatcacccattttccattagaggaaaaaatcaaaataggagagaatctcaccagtagtttgattgccactctgactccctcccattgaaacgttgacacagtcatagaagagaatctttatagaagagtgatagaaaatgtcgtatgaaaaatactctggaacaatttagtcattactagtagggaaccatccaaagccattctccaattagctacacattagaatgaataaaaaagtttccaaaaattctgaagaccaaatccacctaaagatttgatttgattgctccggggctcagcatggttacttagactgttgctataggattttaggtgccaaaactaaactctgtgcttcaatatatagttctgaaaaattgaacagtaaatgactaaatttgttccatgtgtttctttgcagtcacacaatttcgtgatttaattttttatttatttccaaggaacacgcataggttgttacatttttaatcatagtactttggaaataatcctagtttctgttttctaagatatatttccatatctagaagagttttccccatttgctttattctgtttcaataaatcttttcttaattttgtactttaataaaatctctcattaaatgagctgacactgggtagattgatgctgtggccatataatttaatttaagactgtggtaccagtaccatgctgttttggttactgtagccttgtagtatactttgaagtcaggtagcatgatgactccagctttattcttttggcttaggattgacttggcgatgcaggctcctttatggttccatatgaactttaaagtagttttttccaattctctgaagaaaggcattggtagcttgatggggatggcattgaatctataaattaccttgggcagtatggccattttcacgatattgacacttcctacccatgagcatggaatgttcttccatttgtttgtatcctcttttatttcattgagcagtggtttgtagttctccttgaagaggtccttcacatcccttgtaagttggattcctaggtattttattctctttgaagcaattgcgaatgggagttcactcatgatttggctctctgtttgtctgttattggtgtataagaatgcttgtgatttttgcacattgattttgcatgctgagactttgctgaagttgcttatcagcttaaggagattttgggctgagacaatggggttttctagatatacaatcatgtcatctgcaaacaggaacaatttgacttcctcttttcctgattgaataccctttatttccttctcctgcctaattgccctggccagaacttccaacagtatgttgaataggagcagtgagagagggcacccctgtcttgtgccagttttcaaagggaatgcttccagtttttgcccattcagtatgatattggctgtgggttcatcatagatagctcttattattttgagatttgtcccatcaatacctaatttattgagaatttttagcatgaggggtagttgaatattgtcaaaggccttttctggatctattgagataatcatgtggtatttgtgattggttctgtttatatgctggattacgtttattgatttgcatatattgaaccagccttgcatcccagggatgaagcccacttggtcatggtgcataagctttttgatgtgctgctggattcggtttgccagtattttattgaggatttttgcatcgatgttcatcagggatattggtctaaaattctctttttctgtatattacaaggctacagtaaccaaaacagcatggtactggtaccaaaacagagatatagatcaatggaacagaacaaagccctcataaataatgccacatatctacaactatctgatctttgacaaacctcacaaaaacaagaaatggggaaacgattccctatttaataaatggtgctgggaaaactggctagccatatgtagaaagctgaaactggatcccttccttacaccttatacaaaaattaactcaagatggattaaagacttacatgttagacttaaaaccataaaaaccctagaagaaaacctaggcattaccattcaggacataggcacgggcaaggacttcatgacgaaaacaacaaaagcaatggcaacaaaagccaaaattgacaaatgggatctaattaaactaaagagcttctgcacagcaaaagaaactaccatcagagtgaacaggcaacctacagaatgggagaagattttcgcaacctactcctctgacaaagggctaatatccagaatctacaatgaactcaaacaaatgtacaagaaaaaagcaaacaaccccatcaacaagtgggtgaaggatatgaacagacacttctcaaaagaagacatttatgcagccaaaagacacataaaaaaatgctcatcatcactggccatcagagaaatgcaaatcaaaacaacgagataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccgttactgggtatatacccaaaggattataaatcatgctgctataaagacacatgcacacgtatgtttattgcggcactattctcaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggaatgttgtggggtggggggaggggggagggatagcattaggagatatacctaatgttaaatgacgagttaatgggtgtagcacaccaacatggcacatgtatacatatgcaactaacctgcacgttgtgcacatgtaccctaaaacttaaagtattaaaaaaaaagactgtgaattggctaagtgttatcttttgaaataaaatactcctaggtcaacacatgctgttacatcctggcagcatgcagctttattttctaaaagtgtaagctttgcttctgtaggtaagctcatgtcactaaaataagtaacataattttaaatccaattcagaatctgagggcccagagaaataactgatcaattaacacactaaggaagtgagcagctcttttctttcctatagtaataaatgccaatgtgaatgtaaagaagcatcctgatctacatctacttttatatataacaagagtatggttgtcagaaagttgtacatacagtatgcatttccttagtgccatagcttttatatctgaggatctcaaacgatcttaaaatgcagaaaaaataatgctctaaaagattcaaattaactagcaaaactctcagtgcaccacacggtggagtcagacacccacaaatctgcgtgaccagtatatgacagaaaatctgagcaggtatttcaaagaggacttaatatggtaacttcatacattttttcctgcttctccgtgatgaattaagctaaatataccatttatgagaaaagaaattatagtgcactaatattttaattagcaataacctttttatctttaagtgcaaatttatagaaacacatttttgttaatacaatgcattgaagttagtccctattctattcctttcttttctttctttcatctatctatctatctatctatctatctatctatctatctatctatccatccatcaatccatacatccatccatctatccaccccatctctatatttaaaatgtcattttggtggcattcttagtggatccttcatcttacacactgtgcttatgttatttcactatctaacttttgactctctattttatttcatgggaatttcgagctgcttttcaggaaatataatccttgaagcaaatctgagtacctgagaactctgttctagaaaacaattcacttactgccatattaaaataaaaccctggagcagaagaatgttttaagagctttcagatggcttgtattctccaatattatgtattaccattggggagactcaatgtcaagaactatgttgataatgcaggtgtgacctgaaatgcatggaaaatagatttgatctgaatgcccaaaatctctttcttgaagtagatctgaaatttcataatttatctgtgttctgctgtttactagtacttttctactgatgtagttaataacatttttattgtagtatttttttagaaaaaccaagcaaaatattttgctattaaaaacaagtaatgtttataaaatcctgaatccatttctaaataagaaaaaacacacagtgccccttatcacaacctgttcaactaaagatgcttcgccctaaaagctccaattttccttgaaagacaatagtataatagctttgcctatcaaatttgctactcataatttcattccgcaagtctgtcacaaagtaattctttatgcattttgaagtacaaacttgcaatattaatgtctagtattcatactgctcaaatttttccttaattccattcagaacgtcacaagcatttttaatcaaacattccttcaaaactcatgtcattagtttaaatgaaagcagttctactctgtatttcatttatagtcatgtagttcttctcaattcagaaacaattactcattcctatcatgcattttactaaaccctgccgtggtagacacactaaataccctgacttgatcattacactttctatacatgtaagaaaatattacataaatgttgtatccataaatatgtataaatattttatatcaaaaaacctttttcattatgactcaaactgggacggacttaggaatagttaattctagagaacctggcttgtgtaagtttgaaaaatatatatactggagtaggtttgtataaacctatcacacttaccctctaaaatatgtacaatcattatatatcaagacaaattaaaaattgaatcctcaagtatgtttactattatccctcacttctactacaatatttactcttgttgcccagtggaaaactatgatgaggattttatcatcaggattctccccaaaattctctttcttcatccactattgcaattgtatgcactccataaggaaataatattccctggactttttaagcctatcaaaactacctatactctgccacatattatcagggacattcttggtcaaagttagacaatatggtaaattaactcatgctattgtgtatactgttgcccagaacacctattaacggtgattcattaactgtaattgcattgtaaccatgatctacaaatctaatatatcacccccaaattcattttaaagtgaaaaacttcagacatcttcaccaactggcagggagaaggctttgagatttgcagctaaccttctagtgctcctctcatcatagcatggacttggtgattgggttcacaacatgtatataagatttgaaaagcagatctagtaattgcgatcacacaaccctaaagacttttgaataaataatacctatgataacttcacatatgtttaaatgttaattaaaaaatgagaacagcattttaaaaatacttcttacagtgaatgtaaatttagttatggcctaaaatttactcatttaaaagtcaactcagatttattttcaacactattttaattctcattctagaaaaacaggtaaacacgttttatattttcgtttgaatgaagcatgggagtgagtgcatgtagctatattgagcatgatcattaataattgaggtgtaaatttatatcgataattttgtgttactcactgcttgtaactaacacatttttataaaacaatatagaccatgtgactaaacgaggagtttataataaaatgtttgagactgctttccaacaatgccatagaaaatattttctttttttctttttataagatagagtctcgctctgttccaggctggagtacagtggtgcaatctcggctcactgcaacctccgcctcccgtgttcaagtgattctcctgcctcagcctcccgagtagctgggattacaggcgcgtgccaacaaacctggctaatttttgtatttttagtagagacagggtttcaccatgttggccaggctggtcttgaactcctgacattgtgattcgtgggcctcagcatcccaaagggctgggattacaggtgtgagccaccacacccggccaaaaaacattttctttaccatttactatcctatggttttactctagcttttagtatagtttgaagtcagaaacaccagaacgtattgctcctgtctttgaaatgtctttatttcaaattcctccattacatccttaaaaaaataaatcttagactaatgatctagacccccttttcttcctacctacctccaaatagtcaaatcagtgaatcaaaacaaccccatggaaaactagttgaataaatttaaagttagaaacactgcaacattttgttgaagtaataaaaacaaaagaatggaagctgattcccagatgtacttgcctgggcttcctgaggcatttgagctgcgtccaccttgtctgcaatataagctgccaactgcttgtcaatgaatgtgagggactcctggattaagtgtaaggatttttcagtctcctgggcagactggatgctctgttcaagcaacttttgcctccttacagcctaaaaagaaggaataagagtgtatcagttaaatgtttactcttgatagcttttctgtaatcctgctgaacaataaatgaagattctagactcttccacaatcacctttttgtaagacagatttcgcagcttcctggcactcattcagctctgttgatagaaaaaaaatgtgaaggagaaaaataaatagcaaacaaaactataggatcagggatctctgcatgaaaatcaatcacaatatcacgtacattaaggaaataggctggaaaaaaaattagcaaaatcatctcagtcattgcaatctgtctttctcaggtcgaatgttcctcctgatctcatta
